(12) United States Patent
Amann et al.

(10) Patent No.: US 10,526,413 B2
(45) Date of Patent: Jan. 7, 2020

(54) BISPECIFIC ANTIBODIES SPECIFIC FOR OX40

(71) Applicant: Hoffmann-La Roche Inc., Little Falls, NJ (US)

(72) Inventors: Maria Amann, Schlieren (CH); Peter Bruenker, Schlieren (CH); Christina Claus, Schlieren (CH); Claudia Ferrara Koller, Schlieren (CH); Sandra Grau-Richards, Schlieren (CH); Ralf Hosse, Schlieren (CH); Christian Klein, Schlieren (CH); Viktor Levitski, Schlieren (CH); Pablo Umana, Schlieren (CH)

(73) Assignee: Hoffmann-La Roche Inc., Little Falls, NJ (US)

( * ) Notice: Subject to any disclaimer, the term of this patent is extended or adjusted under 35 U.S.C. 154(b) by 114 days.

(21) Appl. No.: 15/280,379

(22) Filed: Sep. 29, 2016

(65) Prior Publication Data

US 2017/0114141 A1    Apr. 27, 2017

(30) Foreign Application Priority Data

Oct. 2, 2015  (EP) ..................................... 15188095
May 19, 2016 (EP) ..................................... 16170363

(51) Int. Cl.
C07K 16/28      (2006.01)
C07K 16/30      (2006.01)
C07K 16/40      (2006.01)
A61K 39/00      (2006.01)

(52) U.S. Cl.
CPC .......... *C07K 16/2878* (2013.01); *C07K 16/30* (2013.01); *C07K 16/3053* (2013.01); *C07K 16/40* (2013.01); *C12Y 304/14005* (2013.01); *A61K 2039/505* (2013.01); *C07K 2317/31* (2013.01); *C07K 2317/52* (2013.01); *C07K 2317/55* (2013.01); *C07K 2317/56* (2013.01); *C07K 2317/565* (2013.01); *C07K 2317/76* (2013.01); *C07K 2317/92* (2013.01)

(58) Field of Classification Search
CPC ................ C07K 16/2878; C07K 16/30; C07K 16/3053; C07K 16/40; C07K 2317/31; C07K 2317/52; C07K 2317/55; C07K 2317/56; C07K 2317/565; C07K 2317/76; C07K 2317/92; C12Y 304/14005; A61K 2039/505
See application file for complete search history.

(56) References Cited

U.S. PATENT DOCUMENTS

| | | | |
|---|---|---|---|
| 5,821,332 A | 10/1998 | Godfrey et al. | |
| 6,277,962 B1 | 8/2001 | Godfrey et al. | |
| 6,545,462 B2 | 4/2003 | Schott et al. | |
| 6,602,684 B1 | 8/2003 | Umana et al. | |
| 7,364,733 B2 | 4/2008 | Godfrey et al. | |
| 7,550,140 B2 | 6/2009 | Bakker et al. | |
| 7,696,175 B2 | 4/2010 | Epstein et al. | |
| 7,959,925 B2 | 6/2011 | Weinberg et al. | |
| 7,960,515 B2 | 6/2011 | Min et al. | |
| 8,133,983 B2 | 3/2012 | Bakker et al. | |
| 8,217,149 B2 | 7/2012 | Irving et al. | |
| 8,236,930 B2 | 8/2012 | Min et al. | |
| 8,283,450 B2 | 10/2012 | Kato et al. | |
| 8,568,727 B2 | 10/2013 | Adolf et al. | |
| 8,614,295 B2 | 12/2013 | Lawson et al. | |
| 8,748,585 B2 | 6/2014 | Attinger et al. | |
| 8,945,571 B2 | 2/2015 | Moessner et al. | |
| 9,006,399 B2 | 4/2015 | Liu et al. | |
| 9,011,847 B2 | 4/2015 | Bacac et al. | |
| 9,028,824 B2 | 5/2015 | Min et al. | |
| 9,163,085 B2 | 10/2015 | Liu et al. | |
| 9,226,938 B2 | 2/2016 | Ast et al. | |
| 9,346,872 B2 | 5/2016 | Duerner et al. | |
| 9,447,159 B2 | 9/2016 | Ast et al. | |
| 9,926,379 B2 | 3/2018 | Bruenker et al. | |
| 9,975,958 B2 | 5/2018 | Bruenker et al. | |
| 10,040,843 B2 | 8/2018 | Duerner et al. | |
| 2001/0044522 A1 | 11/2001 | Godfrey et al. | |
| 2002/0004587 A1 | 1/2002 | Miller et al. | |
| 2003/0143229 A1 | 7/2003 | Park et al. | |
| 2004/0136995 A1 | 7/2004 | Godfrey et al. | |
| 2006/0280728 A1 | 12/2006 | Weinberg et al. | |
| 2007/0077247 A1 | 4/2007 | Godfrey et al. | |
| 2009/0002360 A1 | 1/2009 | Chen et al. | |
| 2010/0203056 A1 | 8/2010 | Irving et al. | |
| 2010/0256340 A1 | 10/2010 | Brinkmann et al. | |
| 2010/0316645 A1 | 12/2010 | Imhof-Jung et al. | |
| 2011/0064751 A1 | 3/2011 | Mossner et al. | |

(Continued)

FOREIGN PATENT DOCUMENTS

CN          1303430 A      1/2011
WO    WO-1995/12673 A1    5/1995

(Continued)

OTHER PUBLICATIONS

Paul, WE. Fundamental Immunology, 3rd ed. Raven Press, NY, Chap. 9, pp. 292-295, 1993.*
Rudikoff S. et al. Proc. Natl. Acad. Sci. USA, 79:1979-1983, 1982.*
Colman, PM. Research in Immunology, Elsevier, NY, 145(1):33-36, 1994.*
U.S. Appl. No. 15/280,379, filed Sep. 29, 2016, Amann et al.
Baumann et al., "Functional expression of CD134 by neutrophils" Eur. J. Immunol. 34:2268-2275 ( 2004).

(Continued)

*Primary Examiner* — Robert S Landsman
(74) *Attorney, Agent, or Firm* — Morrison & Foerster LLP

(57) ABSTRACT

The invention relates to antibody or antibody fragments thereof that bind to OX40, methods of producing these antibodies and fragments, and to methods of using the same.

20 Claims, 66 Drawing Sheets

Specification includes a Sequence Listing.

(56) References Cited

U.S. PATENT DOCUMENTS

| | | |
|---|---|---|
| 2012/0128591 A1 | 5/2012 | Bacac et al. |
| 2012/0184718 A1 | 7/2012 | Bruenker et al. |
| 2013/0330344 A1 | 12/2013 | Lawson et al. |
| 2014/0044703 A1 | 2/2014 | Kato et al. |
| 2014/0294824 A1 | 10/2014 | Attinger et al. |
| 2014/0370019 A1 | 12/2014 | Bruenker et al. |
| 2014/0377284 A1 | 12/2014 | Simons et al. |
| 2015/0098942 A1 | 4/2015 | Curti et al. |
| 2015/0132288 A1 | 5/2015 | Simons et al. |
| 2015/0174268 A1 | 6/2015 | Li |
| 2015/0190506 A1 | 7/2015 | Cheung et al. |
| 2015/0218244 A1 | 8/2015 | Emrich et al. |
| 2015/0218279 A1 | 8/2015 | Min et al. |
| 2015/0307617 A1 | 10/2015 | Du et al. |
| 2015/0307620 A1 | 10/2015 | Vella et al. |
| 2015/0315281 A1 | 11/2015 | Liu et al. |
| 2015/0322119 A1 | 11/2015 | Engelhardt et al. |
| 2016/0060356 A1 | 3/2016 | Bacac et al. |
| 2016/0060357 A1 | 3/2016 | Bacac et al. |
| 2016/0068604 A1 | 3/2016 | Liu et al. |
| 2016/0108123 A1 | 4/2016 | Freeman et al. |
| 2016/0137740 A1 | 5/2016 | Hammond et al. |
| 2016/0152720 A1 | 6/2016 | Kim et al. |
| 2016/0159917 A1 | 6/2016 | Bruenker et al. |
| 2016/0160290 A1 | 6/2016 | Huseni |
| 2016/0161485 A1 | 6/2016 | Chu et al. |
| 2016/0166685 A1 | 6/2016 | Cheung et al. |
| 2016/0200833 A1 | 7/2016 | Amann et al. |
| 2016/0208017 A1 | 7/2016 | Ast et al. |
| 2016/0263240 A1 | 9/2016 | Ast et al. |
| 2016/0340399 A1 | 11/2016 | Amann et al. |
| 2016/0355597 A1 | 12/2016 | Rhee et al. |
| 2017/0000885 A1 | 1/2017 | Rhee et al. |
| 2017/0008971 A1 | 1/2017 | Dennis et al. |
| 2017/0015755 A1 | 1/2017 | Harm et al. |
| 2017/0073386 A1 | 3/2017 | Stewart et al. |
| 2017/0088631 A1 | 3/2017 | Ast et al. |
| 2017/0247467 A1 | 8/2017 | Amann et al. |
| 2017/0290913 A1 | 10/2017 | Cheung et al. |
| 2018/0022813 A1 | 1/2018 | Lazar et al. |
| 2018/0057598 A1 | 3/2018 | Lazar et al. |
| 2018/0064808 A1 | 3/2018 | Friess et al. |
| 2018/0142037 A1 | 5/2018 | Ast et al. |

FOREIGN PATENT DOCUMENTS

| | | |
|---|---|---|
| WO | WO-1995/21251 A1 | 8/1995 |
| WO | WO-1999/42585 A1 | 8/1999 |
| WO | WO-1999/54342 A1 | 10/1999 |
| WO | WO-1999/57151 A2 | 11/1999 |
| WO | WO-1999/57151 A3 | 11/1999 |
| WO | WO-2001/68708 A2 | 9/2001 |
| WO | WO-2001/68708 A3 | 9/2001 |
| WO | WO-2003/106498 A2 | 12/2003 |
| WO | WO-2003/106498 A3 | 12/2003 |
| WO | WO-2006/029879 A2 | 3/2006 |
| WO | WO-2006/029879 A3 | 3/2006 |
| WO | 2006/105021 A2 | 10/2006 |
| WO | 2012/130831 A1 | 10/2006 |
| WO | WO-2006/121810 A2 | 11/2006 |
| WO | WO-2006/121810 A3 | 11/2006 |
| WO | WO-2007/062245 A2 | 5/2007 |
| WO | WO-2007/062245 A3 | 5/2007 |
| WO | WO-2007/077173 A1 | 7/2007 |
| WO | WO-2008/051424 A2 | 5/2008 |
| WO | WO-2008/051424 A3 | 5/2008 |
| WO | WO-2009/079335 A1 | 6/2009 |
| WO | WO-2010/096418 A2 | 8/2010 |
| WO | WO-2010/096418 A3 | 8/2010 |
| WO | 2010/145792 A1 | 12/2010 |
| WO | WO-2011/020783 A2 | 2/2011 |
| WO | WO-2011/020783 A3 | 2/2011 |
| WO | WO-2011/071871 A1 | 6/2011 |
| WO | 2012/020006 A2 | 2/2012 |
| WO | WO-2012/027328 A2 | 3/2012 |
| WO | WO-2012/027328 A3 | 3/2012 |
| WO | WO-2013/008171 A1 | 1/2013 |
| WO | WO-2013/019906 A1 | 2/2013 |
| WO | WO-2013/028231 A1 | 2/2013 |
| WO | 2013/038191 A2 | 3/2013 |
| WO | WO-2012/027328 A3 | 3/2013 |
| WO | WO-2013/038191 A2 | 3/2013 |
| WO | WO-2013/038191 A3 | 3/2013 |
| WO | 2013/092001 A1 | 6/2013 |
| WO | 2013/119202 A1 | 8/2013 |
| WO | WO-2013/119202 A1 | 8/2013 |
| WO | WO-2013/164694 A1 | 11/2013 |
| WO | WO-2014/012479 A1 | 1/2014 |
| WO | WO-2014/089113 A1 | 6/2014 |
| WO | WO-2014/116846 A2 | 7/2014 |
| WO | WO-2014/116846 A3 | 7/2014 |
| WO | WO-2014/148895 A1 | 9/2014 |
| WO | WO-2015/095418 A1 | 6/2015 |
| WO | WO-2015/095423 A2 | 6/2015 |
| WO | WO-2015/095423 A3 | 6/2015 |
| WO | WO-2015/112900 A1 | 7/2015 |
| WO | WO-2015/120198 A1 | 8/2015 |
| WO | WO-2015/135558 A1 | 9/2015 |
| WO | WO-2015/153513 A1 | 10/2015 |
| WO | WO-2015/153514 A1 | 10/2015 |
| WO | WO-2015/153857 A1 | 10/2015 |
| WO | WO-2016/004875 A1 | 1/2016 |
| WO | WO-2016/004876 A1 | 1/2016 |
| WO | WO-2016/034085 A1 | 3/2016 |
| WO | WO-2016/040892 A1 | 3/2016 |
| WO | WO-2016/054555 A2 | 4/2016 |
| WO | WO-2016/054555 A3 | 4/2016 |
| WO | WO-2016/057667 A1 | 4/2016 |
| WO | WO-2016/057841 A1 | 4/2016 |
| WO | WO-2016/061142 A1 | 4/2016 |
| WO | WO-2016/073282 A1 | 5/2016 |
| WO | WO-2016/073378 A1 | 5/2016 |
| WO | WO-2016/073380 A1 | 5/2016 |
| WO | WO-2016/075174 A1 | 5/2016 |
| WO | WO-2016/081384 A1 | 5/2016 |
| WO | WO-2016/092419 A1 | 6/2016 |
| WO | WO-2016/100882 A1 | 6/2016 |
| WO | WO-2016/164480 A1 | 10/2016 |
| WO | WO-2017/055398 A2 | 5/2017 |
| WO | WO-2017/055398 A3 | 5/2017 |

OTHER PUBLICATIONS

Broll et al., "CD137 Expression in Tumor Vessel Walls High Correlation With Malignan Tumors" Am. J. Chin. Pathol 115:543-549 ( 2001).

Buechele et al., "4-1BB ligand modulates direct and Rituximab-induced NK-cell reactivity in chronic lymphocytic leukemia" J Immunol 42:737-748 ( 2012).

Choi et al., "4-1BB Functions As a Survival Factor in Dendnritic Cells" J Immunol 182:4107-4115 ( 2009).

Croft et al., "The significance of OX40 and OX40L to T-cell biology and immune disease" Immunological Reviews 229:173-191, (2009).

Diehl et al., "In Vivo Triggering Through 4-1BB Enables Th-Independent Priming of CTL in the Presence of an Intact CD28 Costimulatory Pathway" J Immunol 168:3755-3762 ( 2002).

Dubrot et al., "Treatment with anti-CD137 mAbs causes intense accumulations of liver T cells without selective antitumor immunotherapeutic effects in this organ" Cancer Immunol Immunother 59:1223-1233 ( 2010).

Futagawa et al., "Expression and function of 4-1 BB and 4-1BB ligand on murine dendritic cells" International Immonology 14:275-286 ( 2002).

Guo et al., "PD-1 Blockade and OX40 Triggering Synergistically Protects against Tumor Growth in a Mutine Model of Ovanian Cancer" PLOS ONE 9( Suppl 2):e89350 (Feb. 2014).

Heinisch et al., "CD137 activation abrogates granulocytemacrophage colony-stimulating factor-mediated anti-apoptosis in neutrophils" Eur. J. Immunol. 30:3441-3346 ( 2000).

Hinner et al., "Costimulatory T cell engagement via a novel bispecific anti-CD137/anti-HER2 protein based on Anticalin® technology" ( 2015).

(56) References Cited

OTHER PUBLICATIONS

Hornig et al., "Combinations of costimulatory antibody-ligand fusion proteins for targeted cancer immunotherapy":( Oct. 14, 2013).
Kienzle et al., "CD137 (ILA/4-1BB), expressed by primary human monocytes, induces monocyte activation and apoptosis of B lymphocytes" International Immonology 12:73-82 ( 2000).
Kim et al., "4-1BB Engagement Costimulates NKT Cell Activation and Exacerbates NKT Cell Ligand-Induced Airway Hyperresponsiveness and Inflammation" J Immunol 180:2062-2068 ( 2008).
Ko et al., "Treatment of advanced tumors with agonistic anti-GITR mAb and its effects on tumor-infiltrating Foxp3+CD25+CD4+ regulatory T cells" JEM 202:885-891 ( 2005).
Kwon et al., "cDNA sequences of two inducible T-cell genes" Proc. Nall. Acad. Sci. USA 86:1963-1967 ( 1989).
Li et al., "Immunotherapy of melanoma with the immune costimulatory monoclonal antibodies targeting CD137" Clinical Pharmacology Advances and Applications 5( Suppl 1):47-53 ( 2013).
Li et al., "Inhibitory Fcy Receptor Engagement Drives Adjuvant and Anti-Tumor Activities of Agonistic CD40 Antibodies" Science 333:1030-1034 ( 2011).
Lin et al., "Fe-dependent expression of CD137 on human NK cells: insights into agonistic effects of anti-CD137 monoclonal antibodies" Blood 112:699-707 ( 2008).
Linch et al., "OX40 agonists and combination immunotherapy: putting the pedal to the metal" Frontiers in Oncology:1-14 (Feb. 16, 2015).
Linche et al., "Combined OX40 ligation plus CTLA-4 blockade" Oncolmmunology 3(3):e28245, ( 2014).
Melero et al., "Monoclonal Antibodies Against the 4-1BB T-cell Activation Molecule Eradicate Established Tumors" Nat Med 3(6):682-685 (Jun. 1997).
Melero et al., "NK1.1 Cells Express 4-1BB (CDw137) Costimulatory Molecule and Are Required for Tumor Immunity Elicited by Anti-4-1BB Monoclonal Antibodies" Cellular Immunology 190:167-172 ( 1998).
Merchant et al., "An Efficient Route to Human Bispecific IgG" Nature Biotechnology 16:677-681 ( 1998).
Mueller et al., "A Novel Antibody—4-1BBL Fusion Protein for Targeted Costimulation in Cancer Immunotherapy" J Immunother (XP009183889), 31(8):714-722 ( 2008).
Murillo et al., "In vivo depletion of DC impairs the anti-tumor effect of agonistic anti-CD137 mAb" Eur. J. Immunol. 39:2424-2436 ( 2009).
Narazaki et al., "CD137 agonist antibody prevents cancer recurrence: contribution of CD137 on both hematopoietic and nonhematopoietic cells" Blood 115:1941-1948 ( 2010).
Nishimoto, et al., "Costimulation of mast cells by 4-1BB, a member of the tumor necrosis factor receptor superfamily, with the high-affinity IgE receptor" Blood 106:4241-4248 ( 2005).
Nocentini et al., "GITR: a multifaceted regulator of immunity belonging to the tumor necrosis factor receptor superfamily" Eu. J. Immunol. 35:1016-1022 ( 2005).
Olofsson, et al., "CD137 Is Expressed in Human Atherosclerosis and Promotes Development of Plaque Inflammation in Hypercholesterolemic Mice" Circulation 117:1292-1301 ( 2008).
Other Database, (Database Biosis (Nov. 16, 2000), Database accession No. PREV200100317614 Blood, vol. 96(11), pp. 730a (2000) XP002755443).
Palazon et al., "Agonist Anti-CD137 mAb Act on Tumor Endothelial Cells to Enhance Recruitment of Activated T Lymphocytes" Cancer Research 71:801-811 ( 2011).
Petrillo et al., "GITR+ regulatory T cells in the treatment of autoimmune diseases" Autoimmunity Reviews 14:117-126 ( 2015).
Renner et al., "Cure of Xenografted Human Tumors by Bispecific Monoclonal Antibodies and Human T Cells" Science 264:833-835 (May 1994).
Reusch et al., "A novel tetravalent bispecific TandAb (CD30/CD16A) efficiently recruits NK cells for the lysis of CD30+ tumor cells" mABs 6( Suppl 3):727-738 ( 2014).
Schwarz et al., "ILA, The Human 4-1BB Homologue, Is Inducible in Lymphoid and Other Cell Lineages" Blood 85:1043-1052 ( 1995).
Sforzini et al., "Targeting of saporin to Hodgkin's lymphoma cells by anti-CD30 and anti-CD25 bispecific antibodies" British Journal of Haematology, 102:1061-1068 ( 1998).
Simeone et al., "Immunomodulating antibodies in the treatment of metastatic melanoma: The experience with anti-CTLA-4, anti-CD137, and anti-PD1" Journal of Immunotoxicology 9:241-247 ( 2012).
Snell et al., "T-cell intrinsic effects of GITR and 4-1BB during viral infection and cancer immunotherapy" Immunological Reviews 244:197-217 ( 2011).
Song et al., "Activation of NF-kB1 by OX40 Contributes to Antigen-Driven T Cell Expansion and Survival" J Immunol 180(11):7240-7248 ( 2008).
Stagg et al., "Anti—ErbB-2 mAb therapy requires type I and II interferons and synergizes with anti-PD-1 or anti-CD137 mAb therapy" Proc. Nall. Acad. Sci. USA 108:7142-7147 ( 2011).
Teng et al., "CD1d-Based Combination Therapy Eradicates Established Tumors in Mice" J Immunol 183:1911-1920 ( 2009).
Vezys, et al., "4-1BB Signaling Synergizes with Programmed Death Ligand 1 Blockade to Augment CD8 T Cell Responses during Chronic Viral Infection" J Immunol (XP055270916), 187:1634-1642; ( 2011).
Von Kempis et al., "Differentiation-dependent and stimulus-specific expression of ILA, the human 4-1BB-homologue, in cells of mesenchymal origin" Osteoarthritis and Cartilage 5:394-406 ( 1997).
Voo et al., "Antibodies Targeting Human OX40 Expand Effector T Cells and Block Inducible and Natural Regulatory T Cell Function" J Immunol 191(7):3641-3650 ( 2013).
Watts, "TNF/TNFR family members in costimulation of T cell responses" Annu. Rev. Immunol 23:23-68 ( 2005).
Weinberg et al., "Engagement of the OX-40 Receptor In Vivo Enhances Antitumor Immunity" J Immunol 164:2160-2169 ( 2000).
Wilcox et al., "Cutting Edge: Expression of Functional CD137 Receptor by Dendritic Cells" J Immunol 168:4262-4267 ( 2002).
Wilcox et al., "Ligation of CD137 receptor prevents and reverses established anergy of CD8 $^+$ cytolytic T lymphocytes in vivo" Blood 103:177-184 ( 2004).
Wyzgol et al., "Generierung und Charakterisierung rekombinanter TNF-Liganden" (in German but see chapter 2 summary in English), ( 2012).
Zhang et al., "CD137 Promotes Proliferation and Survival of Human B Cells" J Immunol 184:787-795 ( 2010).
Al-Shamkhani et al. "OX40 Is Differentially Expressed on Activated Rat and Mouse T Cells and Is the Sole Receptor for the OX40 Ligand," Eur. J. Immunol. 26:1695-1699, (1996).
BD Biosciences catalog No. 554848, retrieved Aug. 13, 2015 from <http://www.bdbiosciences.com/ptProduct.jsp?ccn=554848>, last visited Aug. 13, 2015, 1 page.
BD Biosciences catalog No. 555836, retrieved Aug. 13, 2015 from <http://www.bdbiosciences.com/us/applications/research/t-cell-immunology/regulatory-t-cells/surface-markers/human/purified-mouse-anti-human-cd134-act35-also-known-as-ber-act35/p/555836>, last visited Aug. 13, 2015, 1 page.
BD Biosciences catalog No. 562181, retrieved Aug. 13, 2015 from <http://www.bdbiosciences.com/ptProduct.jsp?ccn=562181>, last visited Aug. 13, 2015, 1 page.
Blazar et al. "Ligation of OX40 (CD134) Regulates Graft-Versus-Host Disease (GVHD) and Graft Rejection in Allogeneic Bone Marrow Transplant Recipients," Blood 101(9):3741-3748, (May 1, 2003, e-pub. Jan. 9, 2003).
Bulliard et al. "OX40 Engagement Depletes Intratumoral Tregs Via Activating FcγRs, Leading to Antitumor Efficacy," Immunol. Cell Biol. 92:475-480, (2014, e-pub. Apr. 15, 2014).
Burocchi et al. "Intratumor OX40 Stimulation Inhibits IRF1 Expression and IL-10 Production by Treg Cells While Enhancing CD40L Expression by Effector Memory T Cells," Eur. J. Immunol. 41:3615-3626, (2011).
Curti et al. "OX40 Is a Potent Immune-Stimulating Target in Late-Stage Cancer Patients," Cancer Res. 73:7189-7198, (2013, e-pub. Oct. 31, 2013).

(56) References Cited

OTHER PUBLICATIONS

Durkop et al. "Expression of the Human OX40 (hOX40) Antigen in Normal and Neoplastic Tissues," *Br. J. Haematol.* 91(4):927-931, (Dec. 1995).

Flutter et al. "Enforced Co-Stimulation and Co-Inhibitory Blockade Synergize to Enhance the Functions of Exhausted CTL,"Abstract 1911 *Blood*, 118(21):833-834, (2011).

Guo et al. "PD-1 Blockade and OX40 Triggering Synergistically Protects Against Tumor Growth in a Murine Model of Ovarian Cancer," *PloS One* 9(2):e89350, (Feb. 27, 2014), 10 Pages.

Hirschhorn-Cymerman et al. "OX40 Engagement and Chemotherapy Combination Provides Potent Antitumor Immunity With Concomitant Regulatory T Cell Apoptosis," *J. Exp. Med.* 206:1103-1116, (May 4, 2009).

Hosida et al. "Produce of Human OX40 Antibody and Its Immunohistochemistry and Western Blot," *Acta Histochem. Cytochem.* 28(5):491, Abstract P-19, (1995).

Imura et al. "The Human OX40/gp34 System Directly Mediates Adhesion of Activated T Cells to Vascular Endothelial Cells," *J. Exp. Med.* 183:2185-2195, (May 1, 1996).

Kaleeba et al. "The OX-40 Receptor Provides a Potent Co-Stimulatory Signal Capable of Inducing Encephalitogenicity in Myelin-Specific CD4+ T Cells," *Int. Immunol.* 10(4):453-461, (1998).

Kjaergaard et al. "Therapeutic Efficacy of OX-40 receptor Antibody Depends on Tumor Immunogenicity and Anatomic Site of Tumor Growth," *Cancer Res.* 60:5514-5521, (Oct. 1, 2000).

Kjaergaard et al. "Augmentation Versus Inhibition: Effects of Conjunctional OX-40 Receptor Monoclonal Antibody and IL-2 Treatment on Adoptive Immunotherapy of Advanced Tumor," *J. Immunol.* 167:6669-6677, (2001).

Li et al. "The Effect of Anti-Human CD134 Monoclonal Antibody on Phytohemagglutinin-Induced mRNA Expression of Perforin in Peripheral Blood Mononuclear Cells," *Cell Mol. Immunol.* 2(6):467-471, (Dec. 2005).

Linch, S.N. et al. "OX40 Agonists and Combination Immunotherapy: Putting the Pedal to the Metal," *Frontiers in Oncology* 5(34):1-14 (Feb. 16, 2015).

Ma et al. "The Expression and The Regulatory Role of OX40 and 4-1BB Heterodimer in Activated Human T Cells," *Blood* 106(6):2002-2010, (2005, e-pub. Jun. 7, 2005).

Melero et al. "Clinical Development of Immunostimulatory Monoclonal Antibodies and Opportunities for Combination," *Clinical Cancer Res.* 19:997-1008, (2013).

Morales-Kastresana et al. "Combined Immunostimulatory Monoclonal Antibodies Extend Survival in an Aggressive Transgenic Hepatocellular Carcinoma Mouse Model," *Clinical Cancer Res.* 19(22):6151-6162, (2013, e-pub. Sep. 12, 2013).

R&D Systems catalog No. MAB3388, retrieved Aug. 13, 2015 from <https://www.rndsystems.com/products/human-ox40-tnfrsf4-antibody-443318_mab3388>.

Rabinovich et al. "Immunosuppressive Strategies That Are Mediated by Tumor Cells," *Annual Rev. Immunol.* 25:267-296, (2007), 34 pages.

Redmond et al. "Defects in the Acquisition of CD8 T Cell Effector Function After Priming With Tumor or Soluble Antigen Can Be Overcome by the Addition of an OX40 Agonist," *J. Immunol.* 179:7244-7253, (2007).

Redmond et al. "Targeting OX40 and OX40L for the Treatment of Autoimmunity and Cancer," *Crit. Rev. Immunol.* 27:415-436, (2007).

Ruby et al. "Anti-OX40 Stimulation In Vivo Enhances CD8+ Memory T Cell Survival and Significantly Increases Recall Responses," *Eur. J. Immunol.* 37:157-166, (2007).

Santa Cruz Biotechnology catalog No. sc-10938, retrieved Aug. 13, 2015 from http://www.scbt.com/datasheet-10938-ox40-q-14-antibody. html, last visited Aug. 13, 2015, 3 pages.

Sugamura et al. "Therapeutic Targeting of the Effector T-Cell Co-Stimulatory Molecule OX40," *Nat. Rev. Immunol.* 4:420-431, (Jun. 2004).

Sun et al. "Preparation of Anti-Human OX40 Functional Monoclonal Antibody and Study of Its Biological Characteristics," *Zhongguo Mianyizue Zazhi* 21(6):403-405, (2005). (English abstract).

Voo et al. "Antibodies Targeting Human OX40 Expand Effector T Cells and Block Inducible and Natural Regulatory T Cell Function," *J. Immunol.* 191:3641-3650, (2013).

Weinberg. "Antibodies to OX-40 (CD134) Can Identify and Eliminate Autoreactive T Cells: Implications for Human Autoimmune Disease," *Mol. Med. Today* 4:76-83, (1998).

Weinberg et al. "Anti-OX40 (CD134) Administration to Nonhuman Primates: Immunostimulatory Effects and Toxicokinetic Study," *J. of Immunotherapy* 29(6):575-585, (Nov./Dec. 2006).

Weinberg et al. "Science Gone Translational: The OX40 Agonist Story," *Immunol. Rev.* 244:218-231, (2011).

Willett et al. "Probing the Interaction Between Feline Immunodeficiency Virus and CD134 by Using the Novel Monoclonal Antibody 7D6 and The CD134 (Ox40) Ligand," *J. Virol.* 81(18):9665-9679, (Sep. 2007).

Xie et al. "Characterization and Application of Two Novel Monoclonal Antibodies Against Human OX40: Costimulation of T Cells and Expression on Tumor As Well As Normal Gland Tissues," *Tissue Antigens* 67:307-317, (2006).

Abcam catalog No. ab76000, retrieved Aug. 13, 2015 from http://www.abcam.com/cd134—ox40-antibody-epr17y-ab76000.html last visited Aug. 13, 2015, 3 pages.

Abcam catalog No. ab76130, retrieved Aug. 13, 2015 from http://www.abcam.com/cd134—ox40-antibody-ep1168y-ab76130.html, last visited Aug. 13, 2015, 3 pages.

Abcam catalog No. ab80677, retrieved Aug. 13, 2015 from <http://www.abcam.com/cd134--ox40-antibody-ap-mab0833-ab80677.html>, last visited Aug. 13, 2015, 3 pages.

AbD Serotec catalog No. MCA2568GA, retrieved Aug. 13, 2015 from <http://www.labome.com/product/AbD-Serotec-Bio-Rad/MCA2568GA.html>, last visited Aug. 13, 2015, 2 pages.

Al-Shamkhani, a. et al. "OX40 Is Differentially Expressed on Activated Rat and Mouse T Cells and Is the Sole Receptor for the OX40 Ligand," *Eur. J. Immunol.* 26:1695-1699, (1996).

Baum, P. et al., "Single-Chain Fv Immunoliposomes for the Targeting of Fibroblast Activation Orc1tern-Exoressmg Tumor Stromal Cells," *Journal of Drug Targeting* 15(6):399-406, (Jul. 1, 2007).

BD Biosciences catalog No. 340420, retrieved Aug. 13, 2015 from <http://www.bdbiosciences.com/ptProduct.jsp?ccn=340420>, last visited Aug. 13, 2015, 1 page.

BD Biosciences catalog No. 554848, retrieved Aug. 13, 2015 from <http://www.bdbiosciences.com/ptProduct.isp?ccn=554848>, last visited Aug. 13, 2015, 1 page.

BD Biosciences catalog No. 555836, retrieved Aug. 13, 2015 from <http://www.bdbiosciences.com/us/applications/research/t-cell-immunoloay/reaulatory-t-cells/surface-markers/human/purified-mouse-anti-human-cd134-act35-also-known-as-ber-act35/p/555836>, last visited Aug. 13, 2015, 1 page.

BD Biosciences catalog No. 562181, retrieved Aug. 13, 2015 from <http://www.bdbiosciences.com/ptProduct.isp?ccn=562181>, last visited Aug. 13, 2015, 1 page.

Blazar, B.R. et al. "Ligation of OX40 (CD134) Regulates Graft-Versus-Host Disease (GVHD) and Graft Rejection in Allogeneic Bone Marrow Transplant Recipients," *Blood* 101(9):3741-3748, (May 1, 2003, e-pub. Jan. 9, 2003).

Bulliard, Y. et al. "OX40 Engagement Depletes Intratumoral Tregs Via Activating FcyRs, Leading to Antitumor Efficacy," *Immunol. Cell Biol.* 92:475-480, (2014, e-pub. Apr. 15, 2014).

Burocchi, A. et al. "Intratumor OX40 Stimulation Inhibits IRF1 Expression and IL-10 Production by Treg Cells While Enhancing CD40L Expression by Effector Memory T Cells," *Eur. J. Immunol.* 41:3615-3626, (2011).

Casset, F. et al. "A Peptide Mimetic of an Anti-CD4 Monoclonal Antibody by Rational Design," *Biochem. Bioph. Res. Co.* 307:198-205, (2003).

Chen, Y. et al. "Selection and Analysis of an Optimized Anti-VEGF Antibody: Crystal Structure of an Affinity-Matured Fab in Complex With Antigen," *J. Mol. Bio.* 293:865-881, (1999).

(56) References Cited

OTHER PUBLICATIONS

Curti, B.D. et al. "OX40 Is a Potent Immune-Stimulating Target in Late-Stage Cancer Patients," *Cancer Res.* 73:7189-7198, (2013, e-pub. Oct. 31, 2013).

De Pascalis, R. et al. "Grafting of 'Abbreviated' Complementarity-Determining Regions Containing Specificity-Determining Residues Essential for Ligand Contact to Engineer a Less Immunogenic Humanized Monoclonal Antibody," *J. Immunol.* 169:3076-3084, (2002).

Durkop, H. et al. "Expression of the Human OX40 (hOX40) Antigen in Normal and Neoplastic Tissues," *Br. J. Haematol.* 91(4):927-931, (Dec. 1995).

Epitomics catalog No. 2359-1, located at <http://www.labome.com/product/Epitomics/2359-1.html>, last visited Aug. 13, 2015, 2 pages.

Ferrara, C. et al. "Modulation of Therapeutic Antibody Effector Functions by Glycosylation Engineering: Influence of Golgi Enzyme Localization Domain and Co-Expression of Heterologous β1, 4-N-acetylglucosaminyltransferase III and Golgi α-mannosidase II," *Biotechnology and Bioengineering* 93(5):851-861, (2006, e-pub. Jan. 24, 2006).

Flutter, B. et al. "Enforced Co-Stimulation and Co-Inhibitory Blockade Synergize to Enhance the Functions of Exhausted CTL," Abstract 1911 *Blood*, 118(21):833-834, (2011).

Foell et al. "T Cell Costimulatory and Inhibitory Receptors As Therapeutic Targets for Inducing Anti-Tumor Immunity," *Curr. Cancer Drug Targets* 7:55-70, (2007).

Genentech, Inc. "View of NCT02410512 on May 29, 2015" ClinicalTrials.gov Archive May 29, 2015 Retrieved from the Internet: <https://clinicaltrials.gov/archive/NCT02410512/2015_05_29> retrieved on Aug. 1, 2016 the whole document, last visited on May 22, 2017, 4 pages.

Hirschhorn-Cymerman, D. et al. "OX40 Engagement and Chemotherapy Combination Provides Potent Antitumor Immunity With Concomitant Regulatory T Cell Apoptosis," *J. Exp. Med.* 206:1103-1116, (May 4, 2009).

Hosida, M. et al. "Produce of Human OX40 Antibody and Its Immunohistochemistry and Western Blot," *Acta Histochem. Cytochem.* 28(5):491, Abstract P-19, (1995).

Huseni, M. et al.: "T Cell-Mediated Cancer Immunotherapy Through OX40 Agonism (Abstract 128)," *European Journal of Cancer* 50(Suppl 6):45 (Nov. 19, 2014).

Imura, A. et al. "The Human OX40/gp34 System Directly Mediates Adhesion of Activated T Cells to Vascular Endothelial Cells," *J. Exp. Med.* 183:2185-2195, (May 1, 1996).

Kaleeba, J.A.R. et al. "The OX-40 Receptor Provides a Potent Co-Stimulatory Signal Capable of Inducing Encephalitogenicity in Myelin-Specific CD4+ T Cells," *Int. Immunol.* 10(4):453-461, (1998).

Kim, J.M. "Abstract DDT01-02: Unleashing Anti-Tumor Immunity Through Anti-OX40 Monotherapy and in Combination with Anti-PD-L1," *Proceedings: AACR 106th Annual Meeting* (Apr. 18-22, 2015) 4 pages.

Kjaergaard, J. et al. "Therapeutic Efficacy of OX-40 receptor Antibody Depends on Tumor Immunogenicity and Anatomic Site of Tumor Growth," *Cancer Res.* 60:5514-5521, (Oct. 1, 2000).

Kjaergaard, J. et al. "Augmentation Versus Inhibition: Effects of Conjunctional OX-40 Receptor Monoclonal Antibody and IL-2 Treatment on Adoptive Immunotherapy of Advanced Tumor," *J. Immunol.* 167:6669-6677, (2001).

Lamminmaki, U. et al. "Crystal Structure of a Recombinant Anti-Estradiol Fab Fragment in Complex With 17β-Estradiol," *Journal of Biological Chemistry* 276(39):36687-36694, (Sep. 28, 2011).

Li, M. et al. "The Effect of Anti-Human CD134 Monoclonal Antibody on Phytohemagglutinin-Induced mRNA Expression of Perforin in Peripheral Blood Mononuclear Cells," *Cell Mol. Immunol.* 2(6):467-471, (Dec. 2005).

Ma, B.Y. Y et al. "The Expression and the Regulatory Role of OX40 and 4-1BB Heterodimer in Activated Human T Cells," *Blood* 106(6):2002-2010, (2005, e-pub. Jun. 7, 2005).

Maccallum, R.M. et al. "Antibody-Antigen Interactions: Contact Analysis and Binding Site Topography," *J. Mol. Biol.* 262:732-745, (Oct. 11, 1996).

Melero, I. et al. "Clinical Development of Immunostimulatory Monoclonal Antibodies and Opportunities for Combination," *Clinical Cancer Res.* 19:997-1008, (2013).

Melero, I. et al. "Agonist Antibodies to TNFR Molecules That Costimulate T and NK Cells," *Clin. Cancer Res.* 19(5):1044-1053 (Mar. 1, 2013), 20 pages.

Mersmann, M.. "Human Antibody Derivatives Against the Fibroblast Protein for Tumor Stroma Targeting of Carcinomas," *International Journal of Cancer* 92(2):240-248 (Apr. 15, 2001).

Morales-Kastresana, A. et al. "Combined Immunostimulatory Monoclonal Antibodies Extend Survival in an Aggressive Transgenic Hepatocellular Carcinoma Mouse Model," *Clinical Cancer Res.* 19(22):6151-6162, (2013, e-pub. Sep. 12, 2013).

Morales-Kastresana, A. et al. "Therapeutic Activity of a Combination of Immunostimulatory Monoclonal Antibodies (Anti-B7-H1, CD137 and OX40) on a c-myc-Driven Spontaneous Transgenic Model of Hepatocellular Carcinoma," *J. for Immunotherapy of Cancer* 1(Suppl. 1):7 (Nov. 7, 2013) 1 page.

Padlan, E.A. et al. Structure of an Antibody-Antigen Complex; Crystal Structure of the HyHEL-10 Fab-lysozyme Complex, *Proc. Natl. Acad. Sci. USA* 86:5938-5942, (Aug. 1989).

Prell, R. et al. "Nonclinical Safety Assessment of a Humanized Anti-OX40 Agonist Antibody, MOXR0916 (Abstract 424)," *European Journal of Cancer* 50(Suppl. 6):136, (Nov. 20, 2014).

R&D Systems catalog No. MAB3388, retrieved Aug. 13, 2015 from <https://www.rndsystems.com/products/human-ox40-tnfrsf4-antibody-443318_mab3388>, last visited on Aug. 13, 2015, 3 pages.

Rabinovich, G.A. et al. "Immunosuppressive Strategies That Are Mediated by Tumor Cells," *Annual Rev. Immunol.* 25:267-296, (2007), 34 pages.

Redmond, W.L. et al. "Defects in the Acquisition of CD8 T Cell Effector Function After Priming With Tumor or Soluble Antigen Can Be Overcome by the Addition of an OX40 Agonist," *J. Immunol.* 179:7244-7253, (2007).

Redmond, W.L. et al. "Targeting OX40 and OX4OL for the Treatment of Autoimmunity and Cancer," *Crit. Rev. Immunol.* 27:415-436, (2007).

Ruby, C.E. et al. "Anti-OX40 Stimulation in Vivo Enhances CD8+ Memory T Cell Survival and Significantly Increases Recall Responses," *Eur. J. Immunol.* 37:157-166, (2007).

Santa Cruz Biotechnology catalog No. sc-10938, retrieved Aug. 13, 2015 from <http://www.scbt.com/datasheet-10938-ox40-g-14-antibody.html> last visited Aug. 13, 2015, 3 pages.

Santa Cruz Biotechnology catalog No. sc-11403, retrieved Aug. 13, 2015 from <http://www.scbt.com/datasheet-11403-ox40-h-133-antibody.html> last visited Aug. 13, 2015, 3 pages.

Santa Cruz Biotechnology catalog No. sc-20073, retrieved Aug. 13, 2015 from <http://www.scbt.com/datasheet-20073-ox40-ber-act35-antibody.html>, last visited Aug. 13, 2015, 3 pages.

Santa Cruz Biotechnology catalog No. sc-376014, retrieved Aug. 13, 2015 from <http://www.scbt.com/datasheet-376014-ox40-h-10-antibody.html> last visited Aug. 13, 2015, 3 pages.

Shields, R.L. et al. "Lack of Fucose on Human IgG1 N-Linked Oligosaccharide Improves Binding to Human FcγRIII and Antibody-Dependent Cellular Toxicity," *J. Biological Chemistry* 277(30):26733-26470, (Jul. 26, 2002).

Sugamura, K. et al. "Therapeutic Targeting of the Effector T-Cell Co-Stimulatory Molecule OX40," *Nat. Rev. Immunol.* 4(6):420-431, (Jun. 2004).

Sun, J-J.et al "Preparation of Anti-Human OX40 Functional Monoclonal Antibody and Study of Its Biological Characteristics," *Zhonqquo Mianyizue Zazhi* 21(6):403-405, (Jun. 2005). (English abstract).

Vajdos, F.F. et al. " Comprehensive Functional Maps of the Antigen-Binding Site of an Anti-ErbB2 Antibody Obtained With Shotgun Scanning Mutagenesis," *J. Mol. Biol.* 320:415-428, (Jul. 5, 2002).

Weinberg, A.D. "Antibodies to OX-40 (CD134) Can Identify and Eliminate Autoreactive T Cells: Implications for Human Autoimmune Disease," *Mol. Med. Today* 4:76-83, (1998).

(56) References Cited

OTHER PUBLICATIONS

Weinberg, A.D. et al. "Anti-OX40 (CD134) Administration to Nonhuman Primates: Immunostimulatory Effects and Toxicokinetic Study," *J. of Immunotherapy* 29(6):575-585, (Nov./Dec. 2006).
Weinberg, A.D. et al. "Science Gone Translational: The OX40 Agonist Story," *Immunol. Rev.* 244:218-231, (2011).
Willett, B.J. et al. "Probing the Interaction Between Feline Immunodeficiency Virus and CD134 by Using the Novel Monoclonal Antibody 7D6 and the CD134 (Ox40) Ligand," *J. Virol.* 81(18):9665-9679, (Sep. 2007).
Wu, H. et al. "Humanization of a Murine Monoclonal Antibody by Simultaneous Optimization of Framework and CDR Residus," *J. Mol. Biol.* 294:151-162, (Nov. 19, 1999).
Wyzgol, A. (May 2007 to Mar. 31, 2012). "Eneration and Characterization of Recombinant TNF Ligands," Thesis, Dissertation for Obtaining the Science degree the Bavarian Julius-Maximilians-University of Würzburg, Würzburg, Germany, Medical Clinic and Polyclinic II in the Department of Molecular Internal Medicine of the Bavarian Julius-Maximilians-University of Würzburg under the guidance of Prof. Dr. Harald Wajant,112 pages, (p. 11, English Summary).
Wyzgol, A. et al. (Aug. 1, 2009). "Trimer Stabilization, Oligomerization, and Antibody-Mediated Cell Surface Immobilization Improve the Activity of Soluble Trimers of CD27L, CD4OL, 41BBL, and Glucocorticoid-Induced TNF Receptor Ligand," The Journal of Immunology 183(3):1851-1861.
Wyzgol, A. el al. " Generation and Characterisation of Recombinant TNF Ligands," Dissertation—Bavarian Julius-Maximilian University of Würzburg, 220 pages, (2012) (including English translation).
Xie, F. et al. "Characterization and Application of Two Novel Monoclonal Antibodies Against Human OX40: Costimulation of T Cells and Expression on Tumor As Well As Normal Gland Tissues," *Tissue Antigens* 67:307-317, (2006).
Invitation to Pay Additional Fees dated Jan. 13, 2017, for PCT Application No. PCT/EP2016/073198, filed on Sep. 29, 2016, 8 pages.
Notification of Decision on Protest or Declaration That Protest Considered Not to Have Been Made, dated Mar. 15, 2017, for PCT Application No. PCT/EP2016/073198, filed on Sep. 29, 2016, 6 pages.
International Search Report dated Mar. 15, 2017, for PCT Application No. PCT/EP2016/073198, filed on Sep. 29, 2016, 11 pages.
International Preliminary Report on Patentability, dated Feb. 19, 2013 for PCT/EP2011/063648, filed Aug. 9, 2011, 12 pages.
International Search Report, dated Feb. 14, 2012, for PCT Application No. PCT/EP2011/063648, filed Aug. 9, 2011, 7 pages.
Written Opinion dated Mar. 15, 2017, for PCT Application No. PCT/EP2016/073198, filed on Sep. 29, 2016, 15 pages.
Written Opinion of the International Searching Authority, dated Feb. 14, 2012, for PCT/EP2011/063648, filed Aug. 9, 2011, 11 pages.
U.S. Appl. No. 15/913,713, Bruenker et al., filed Mar. 6, 2018.

* cited by examiner

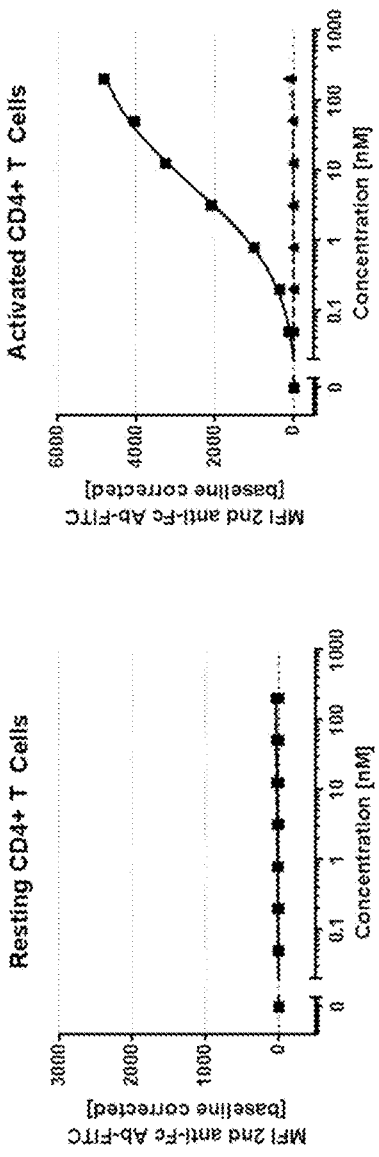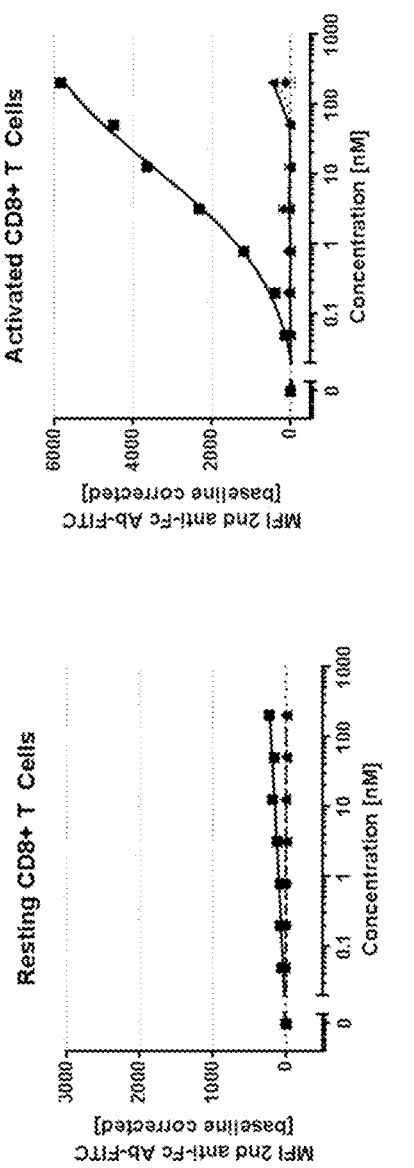

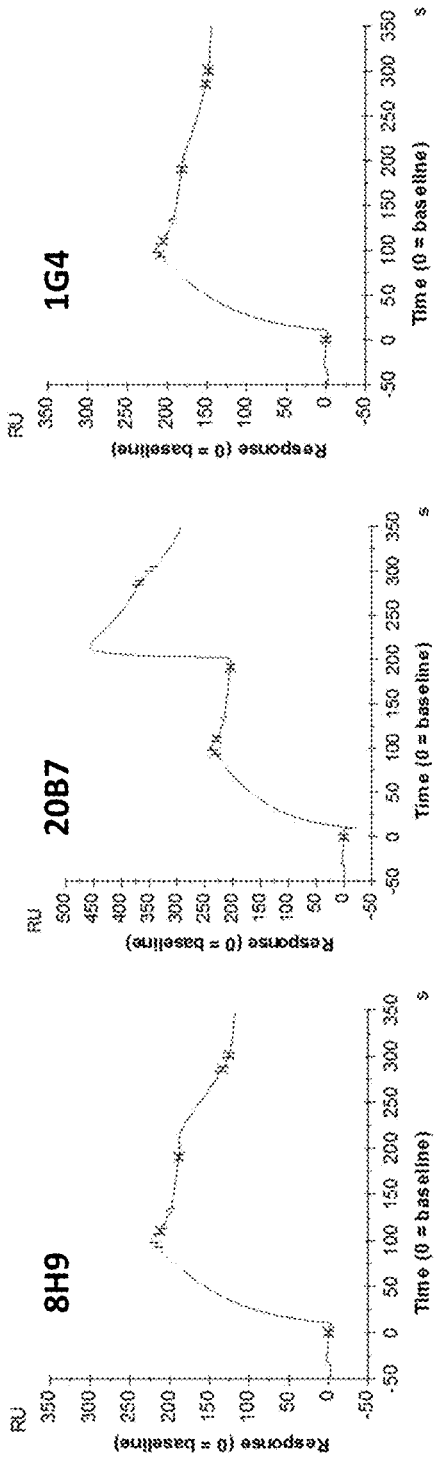

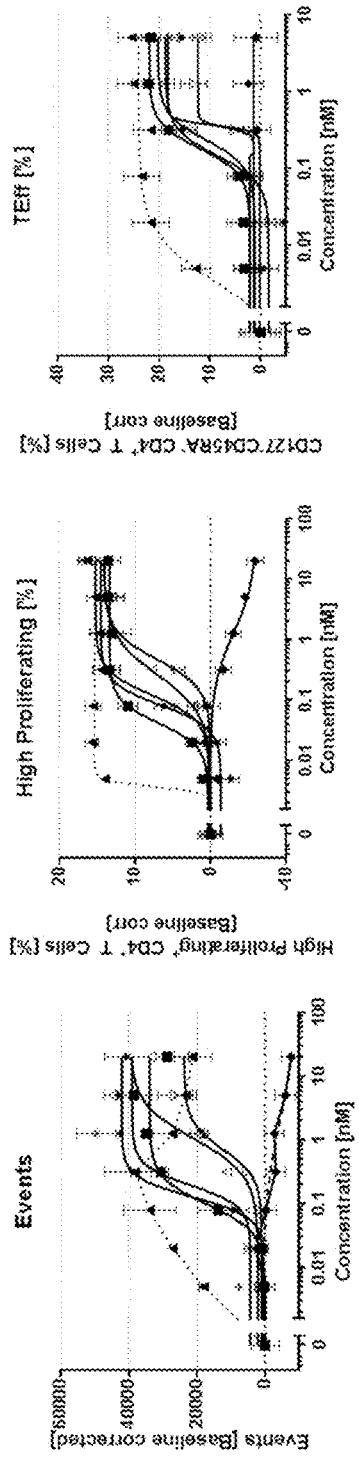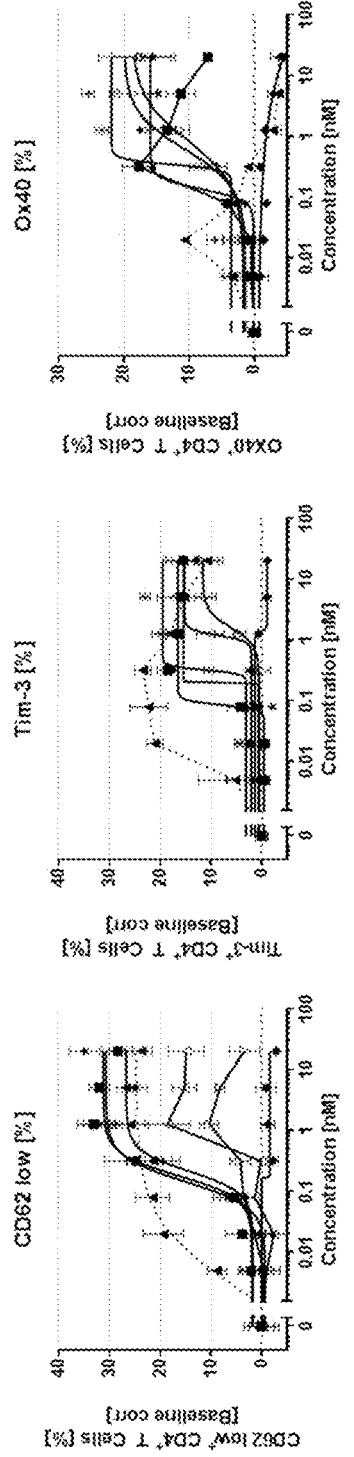

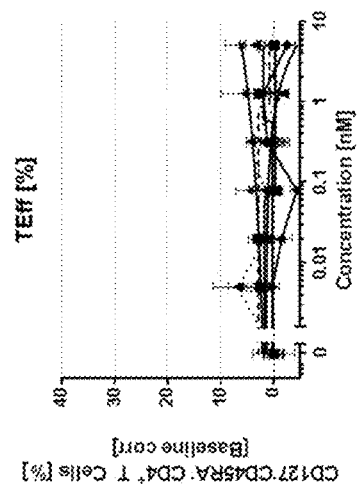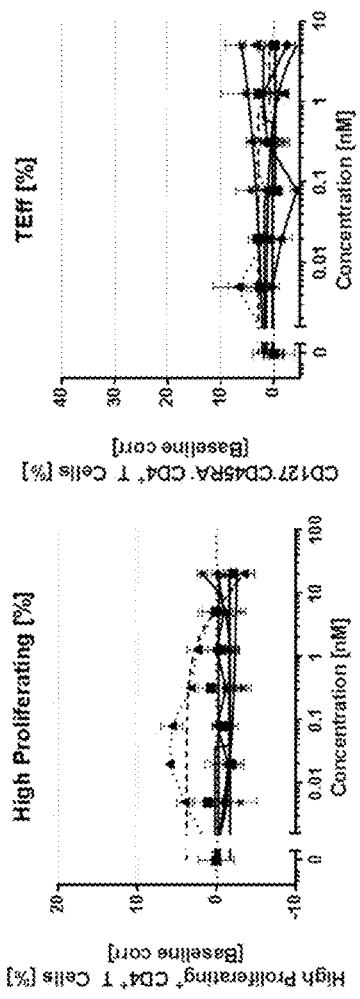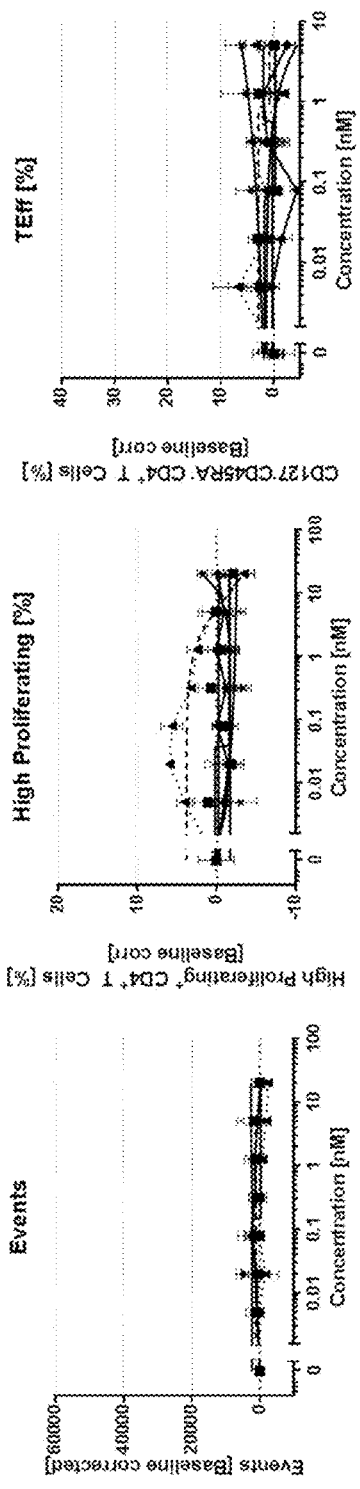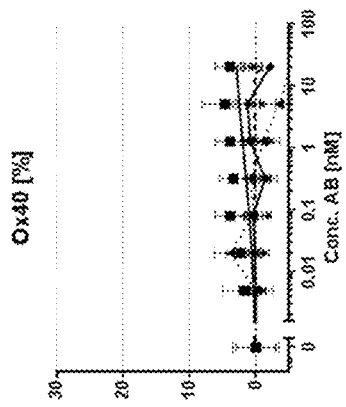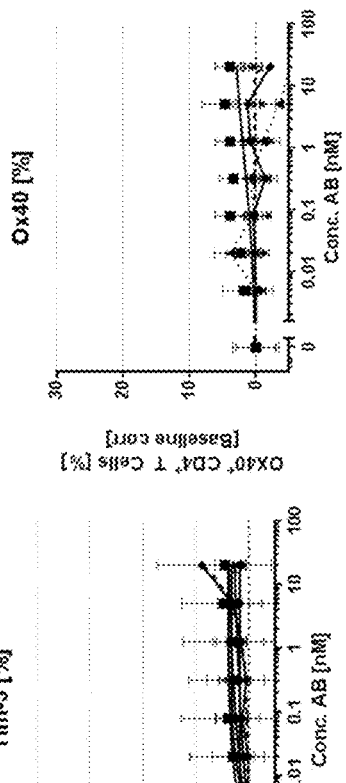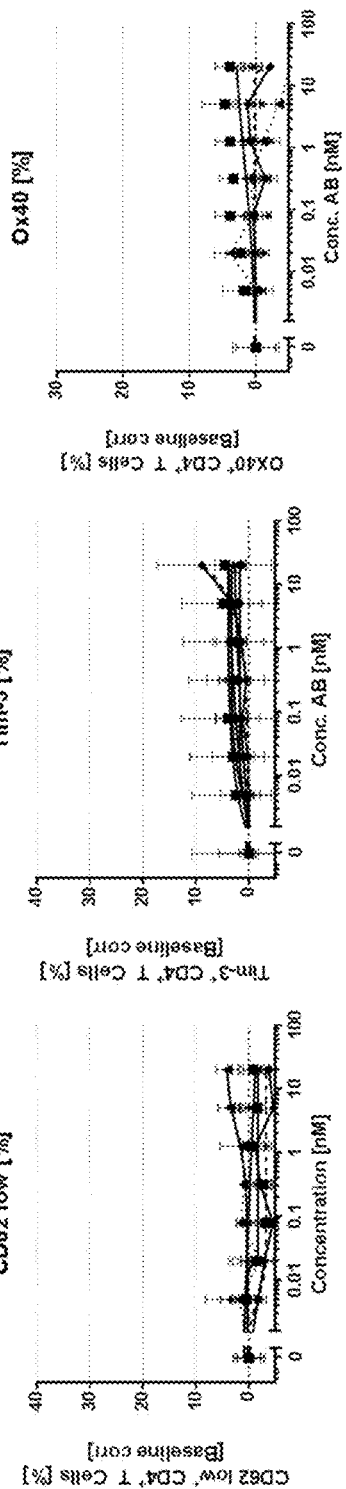

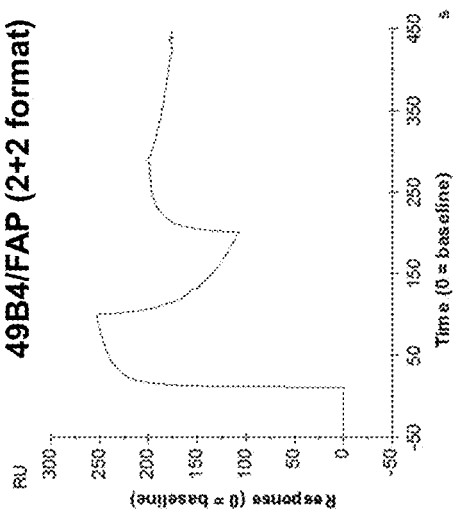
FIG. 13A 8H9/FAP (2+2 format)
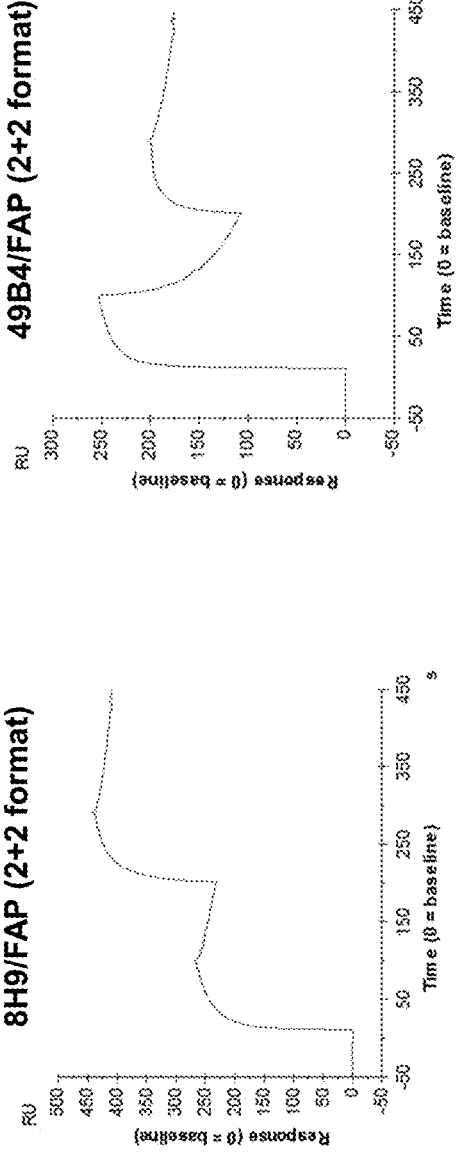
FIG. 13B 49B4/FAP (2+2 format)
FIG. 13C 1G4/FAP (2+2 format)
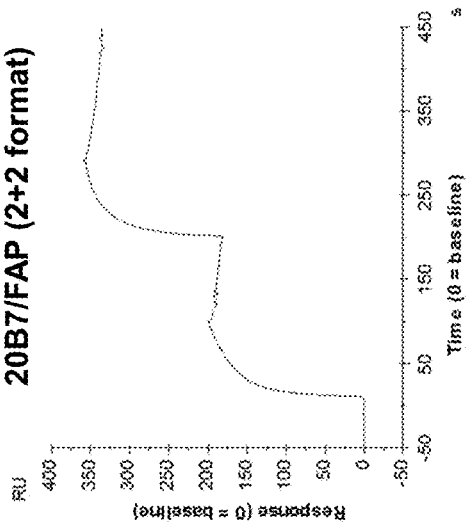
FIG. 13D 20B7/FAP (2+2 format)
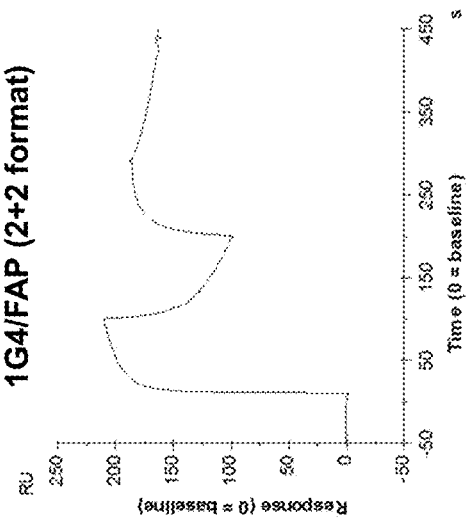

8H9/FAP (1+1 format)

49B4/FAP (1+1 format)

1G4/FAP (1+1 format)

20B7/FAP (1+1 format)

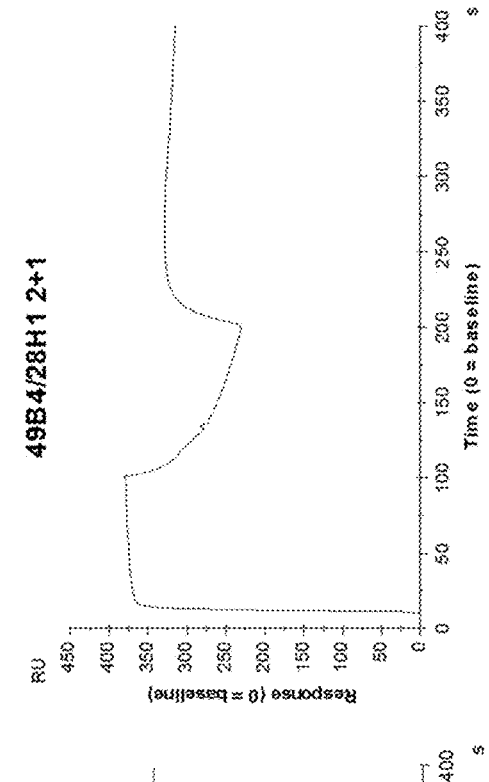
FIG. 13J  49B4/4B9 2+1
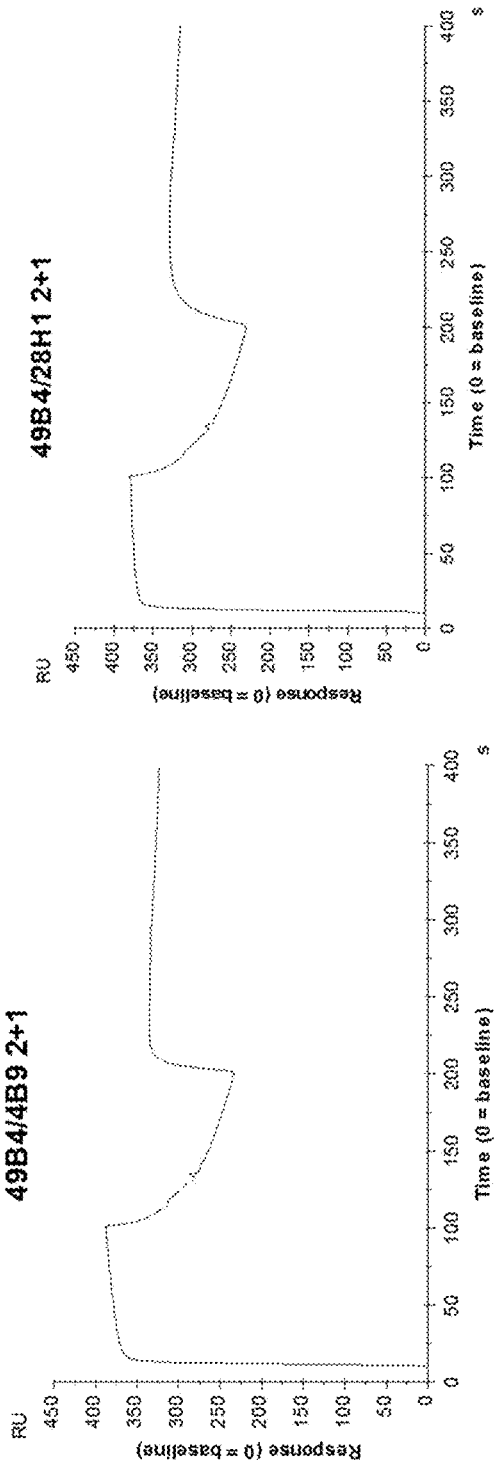
FIG. 13K  49B4/28H1 2+1
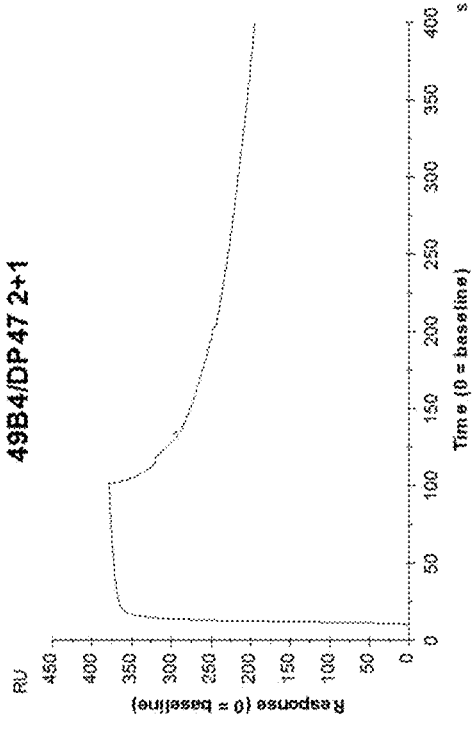
FIG. 13L  49B4/DP47 2+1

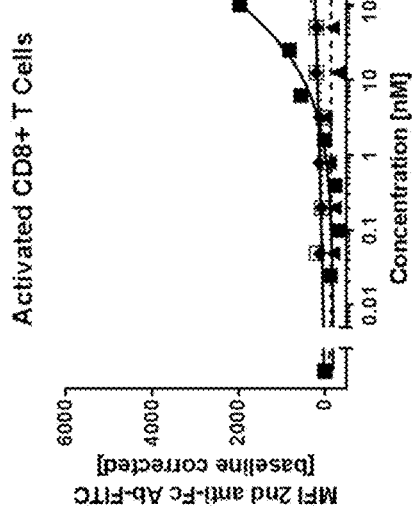
FIG. 14A
Resting CD8+ T Cells
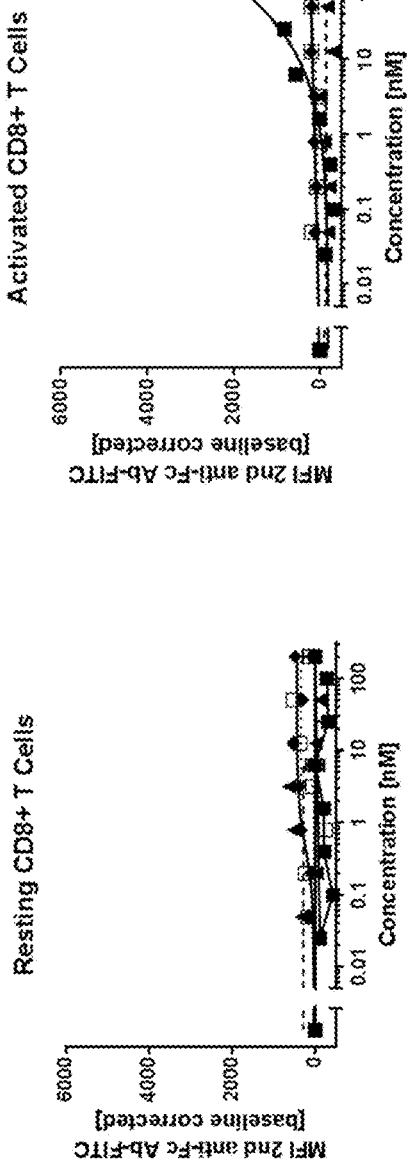
FIG. 14B
Activated CD8+ T Cells
FIG. 14C
Resting CD4+ T Cells
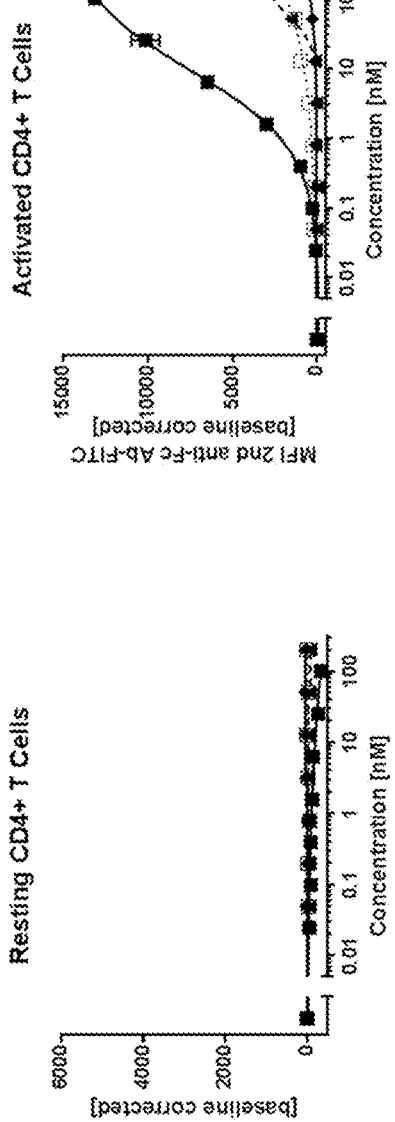
FIG. 14D
Activated CD4+ T Cells
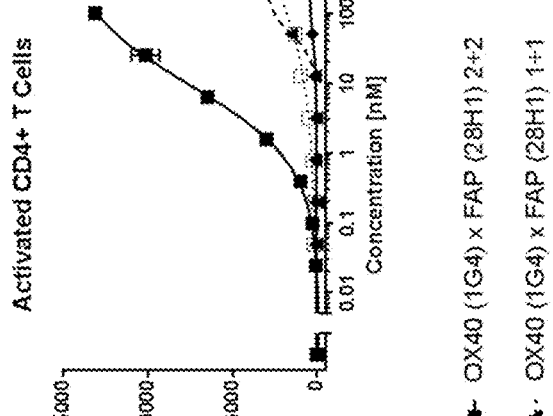

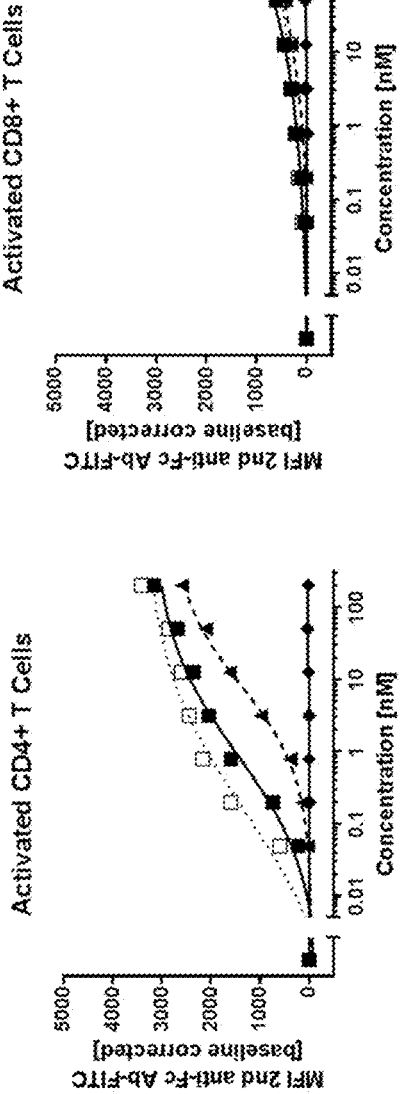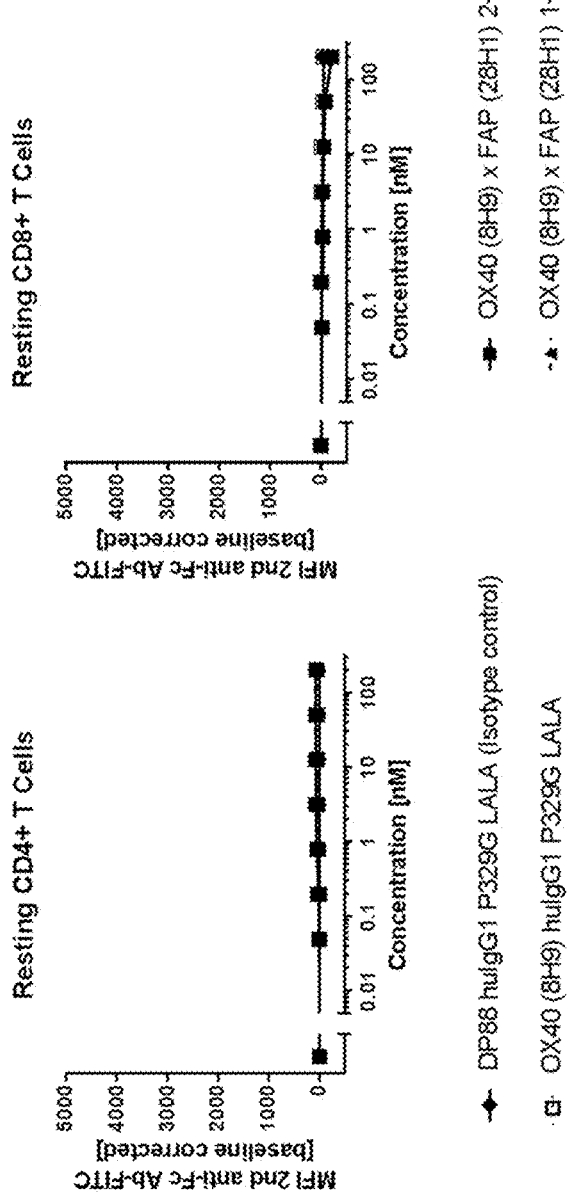

Resting CD4+ T Cells

Activated CD4+ T Cells

Resting CD8+ T Cells

Activated CD8+ T Cells

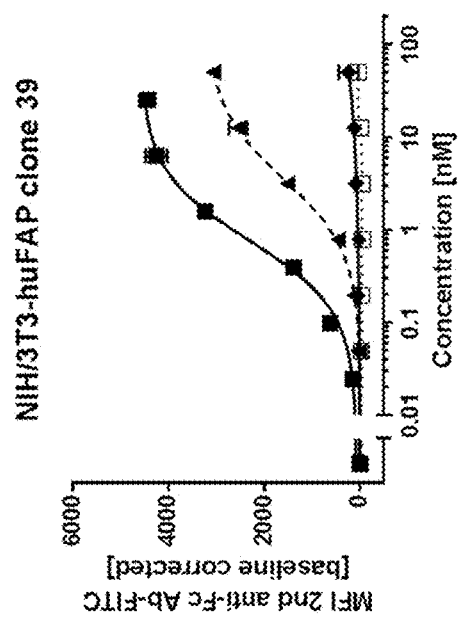

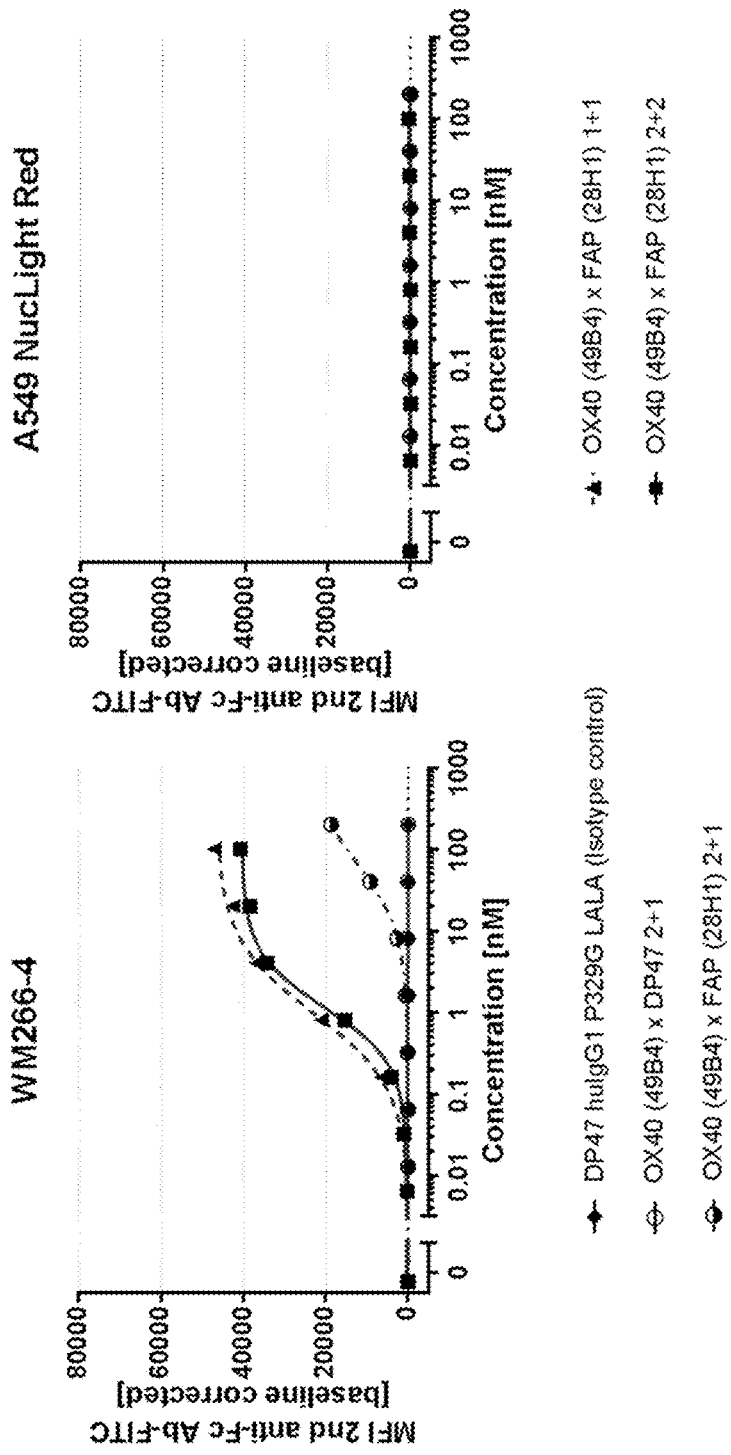

wo

2nd antibody
anti-huIgG1 Fcγ-specific

NIH/3T3-huFAP clone 39

WM-266-4

— ■ — OX40 (49B4) x FAP (28H1) 2+2
– ▲ – OX40 (49B4) x FAP (28H1) 1+1
— ◆ — DP88 huIgG1 P329G LALA (isotype control)
– □ – OX40 (1G4) huIgG1 P329G LALA

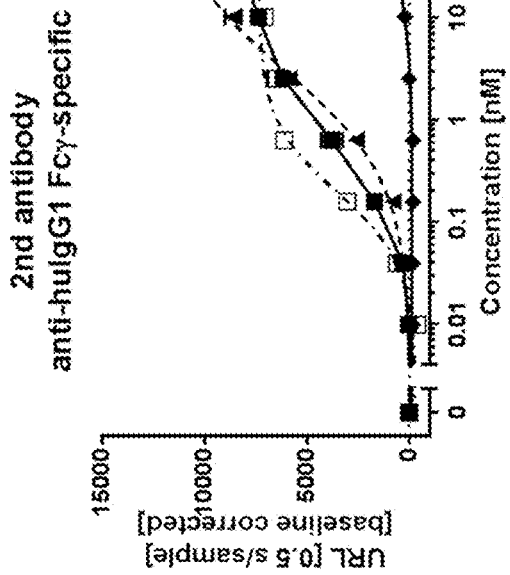
FIG.16E
wo
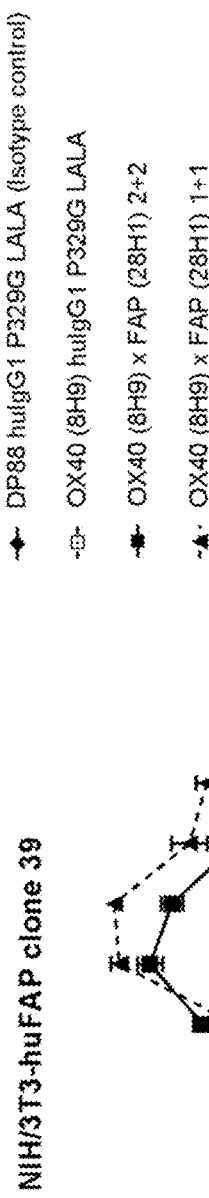
FIG.16F
2nd antibody
anti-huIgG1 Fcγ-specific
- ◆ DP88 huIgG1 P329G LALA (Isotype control)
- ◻ OX40 (8H9) huIgG1 P329G LALA
- ■ OX40 (8H9) x FAP (28H1) 2+2
- ▲ OX40 (8H9) x FAP (28H1) 1+1
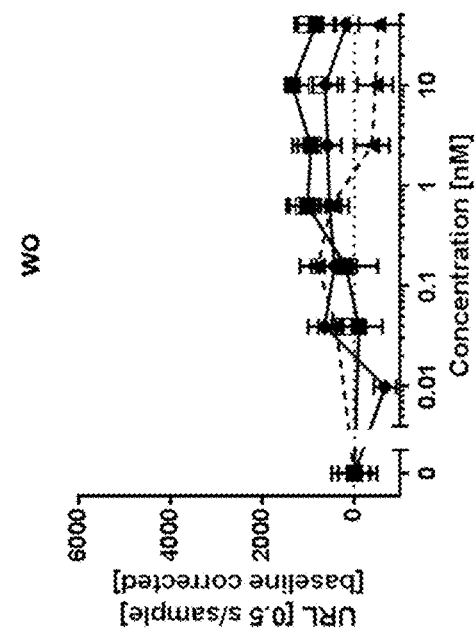
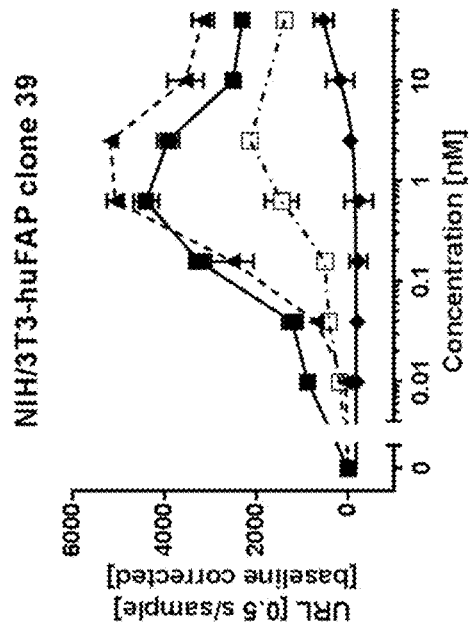
FIG.16G
NIH/3T3-huFAP clone 39

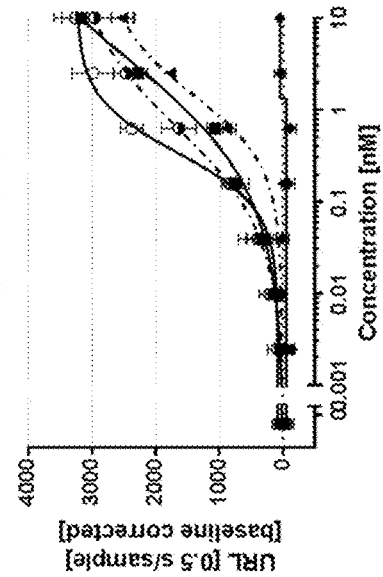
FIG.16J
2nd antibody
anti-huIgG1 Fcγ-specific
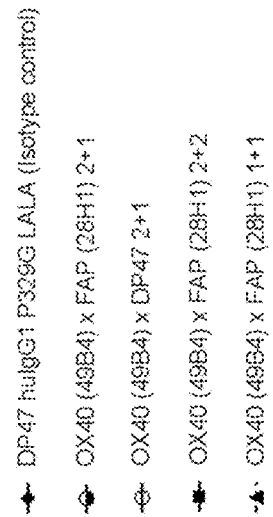
- DP47 huIgG1 P329G LALA (isotype control)
- OX40 (49B4) x FAP (28H1) 2+2
- OX40 (49B4) x DP47 2+1
- OX40 (49B4) x FAP (28H1) 2+1
- OX40 (49B4) x FAP (28H1) 1+1
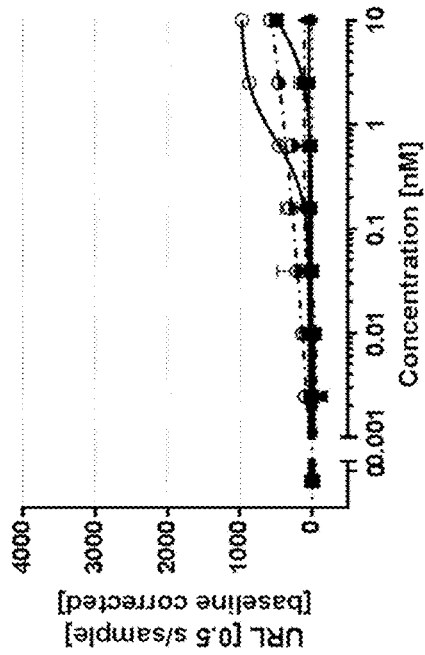
FIG.16H
w/o
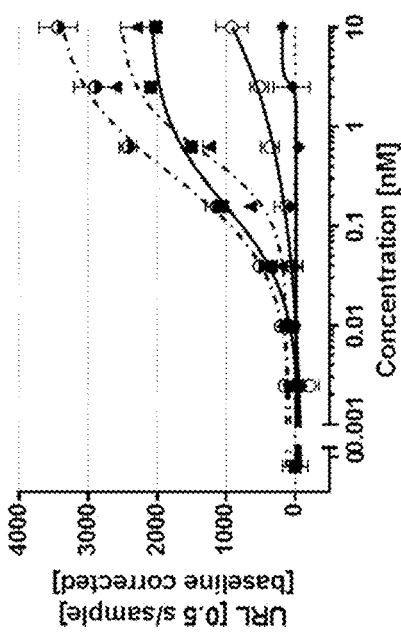
FIG.16K
NIH/3T3-hu-FAP clone 19

- ◆ DP88 huIgG1 P329G LALA (Isotype control)
- ◇ OX40 (1G4) huIgG1 P329G LALA
- ■ OX40 (1G4) x FAP (28H1) 2+2
- ▲ OX40 (1G4) x FAP (28H1) 1+1

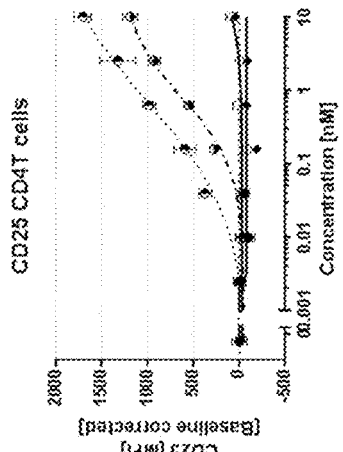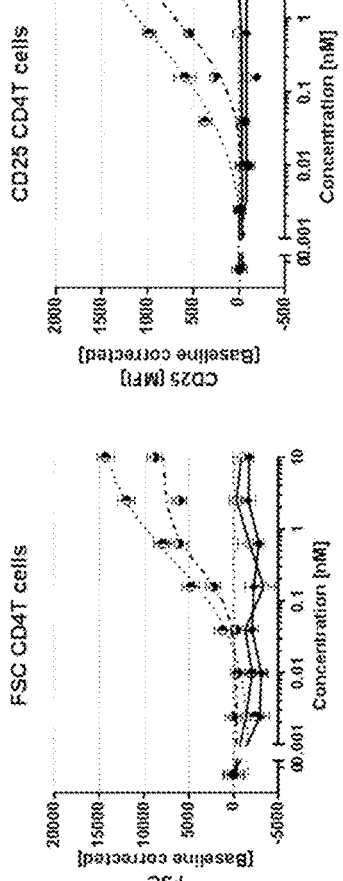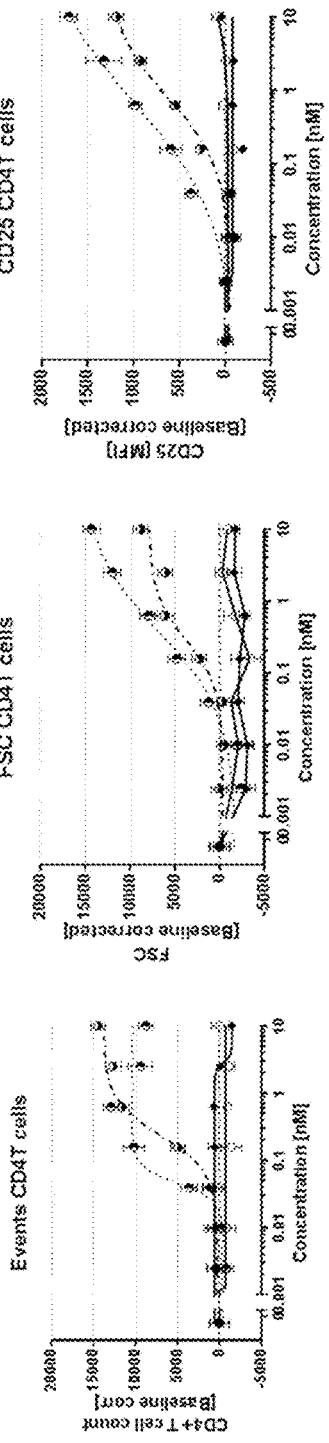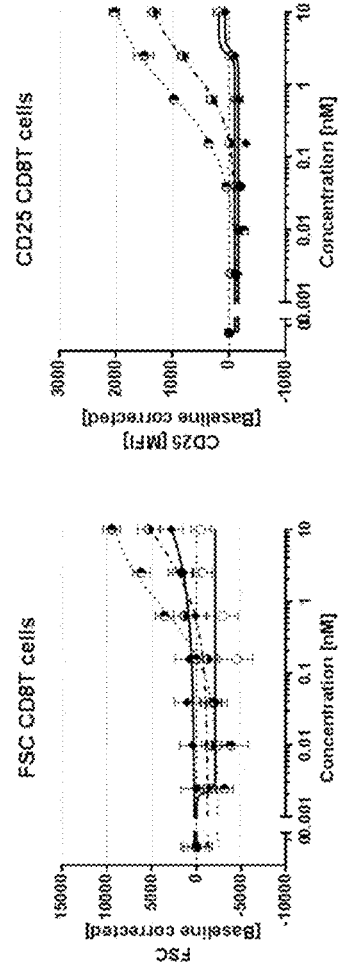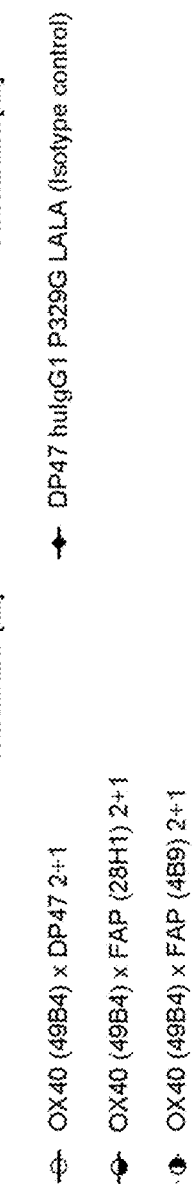

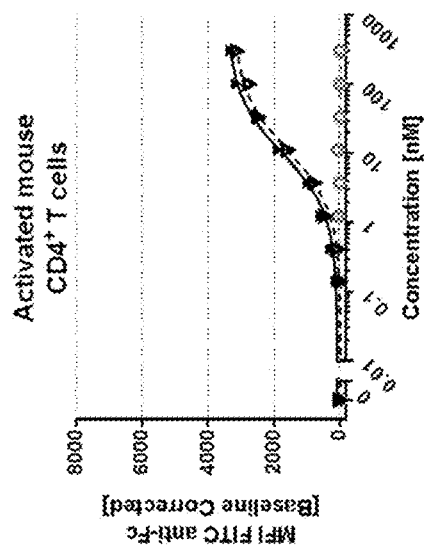
FIG. 25A
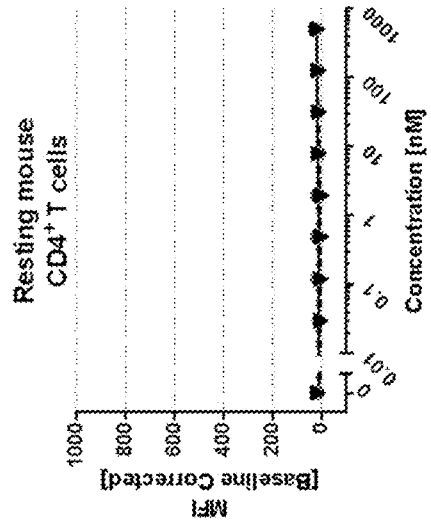
FIG. 25B
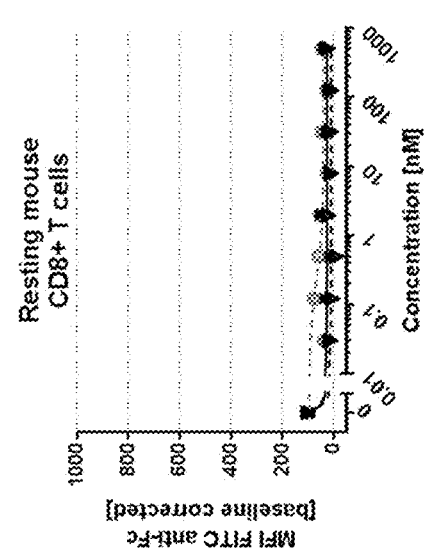
FIG. 25D
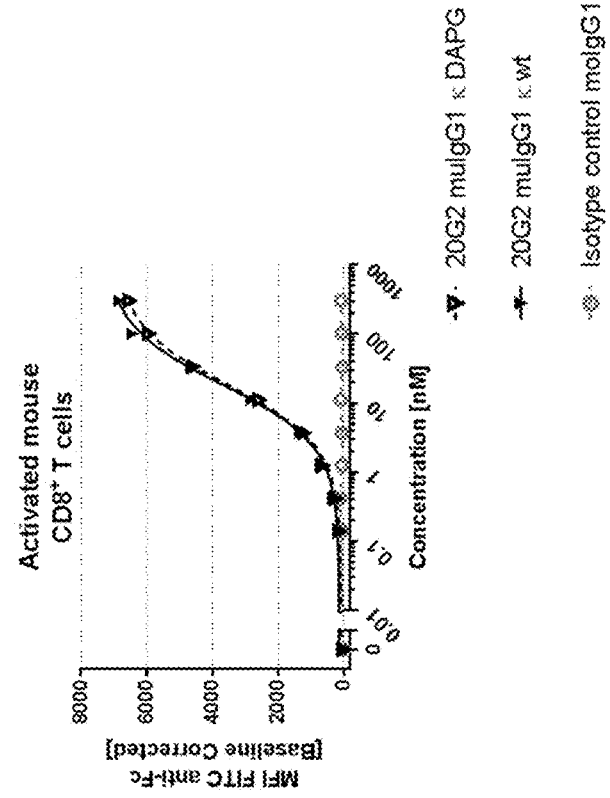

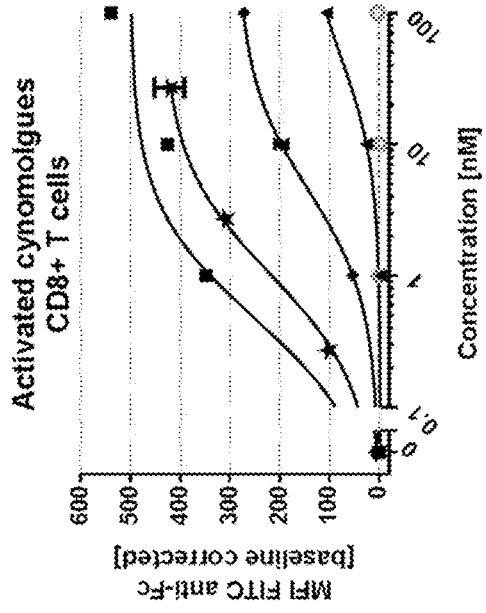
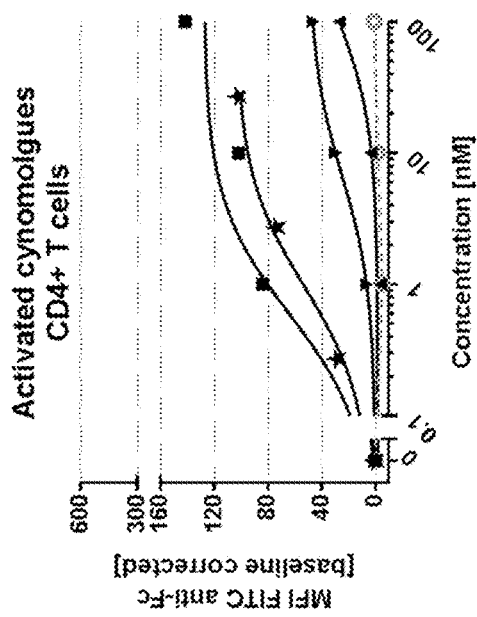
FIG. 26A
FIG. 26B

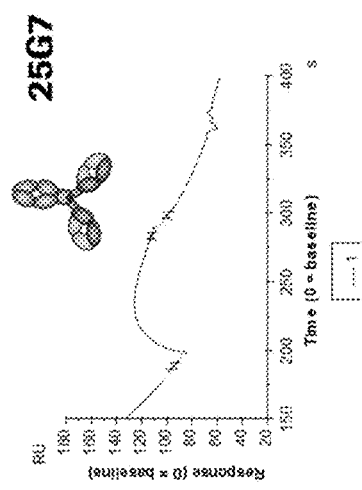
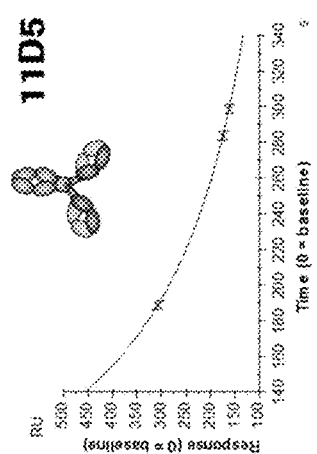
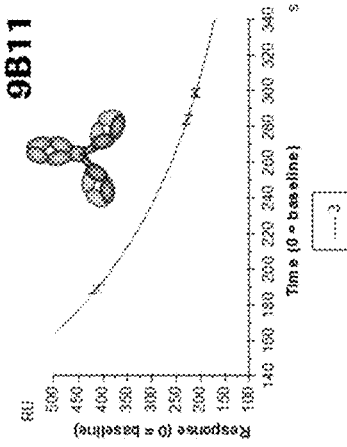
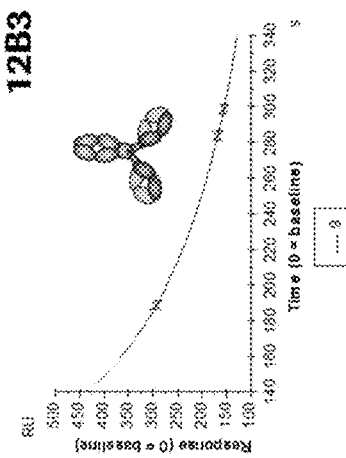
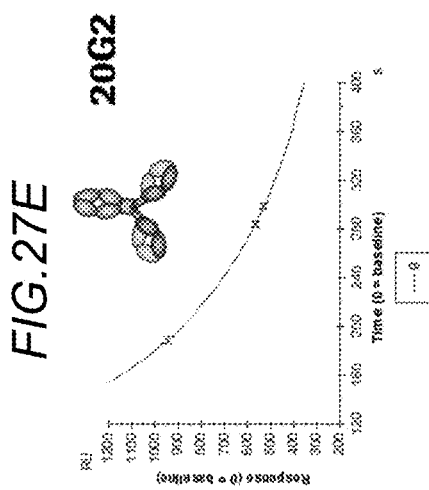
FIG. 27A 25G7
FIG. 27B 11D5
FIG. 27C 9B11
FIG. 27D 12B3
FIG. 27E 20G2

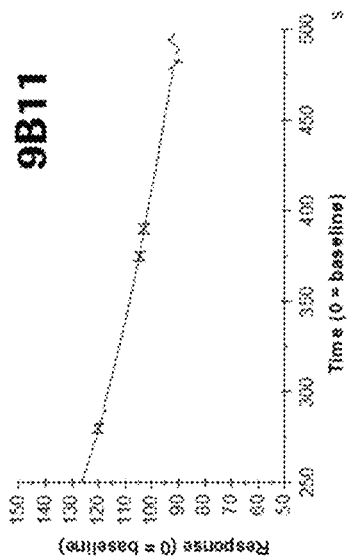
FIG.28D 12B3
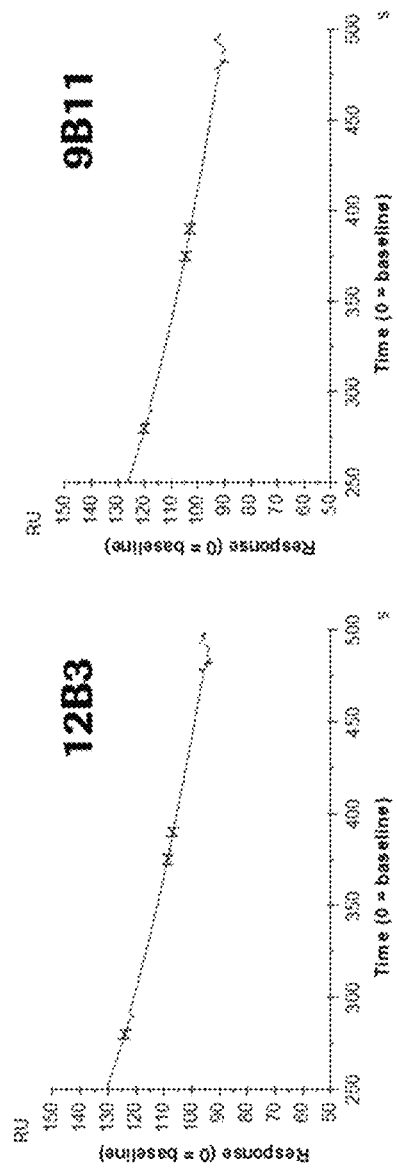
FIG.28E 9B11
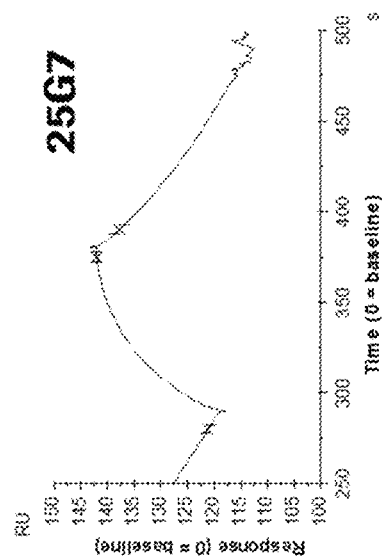
FIG.28F 25G7

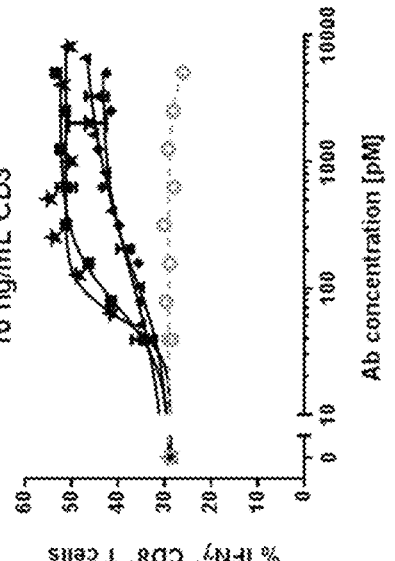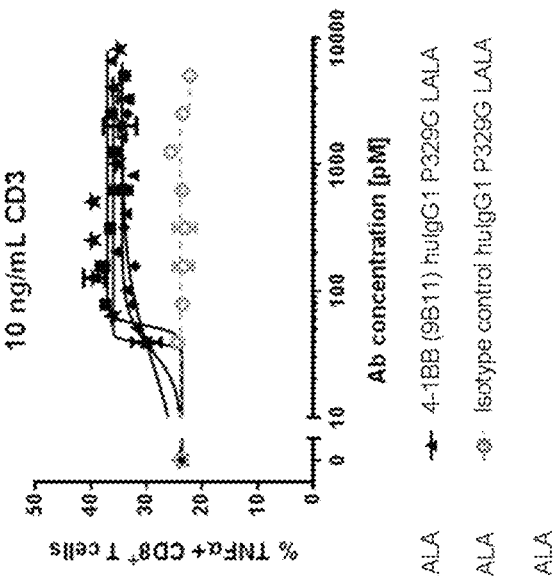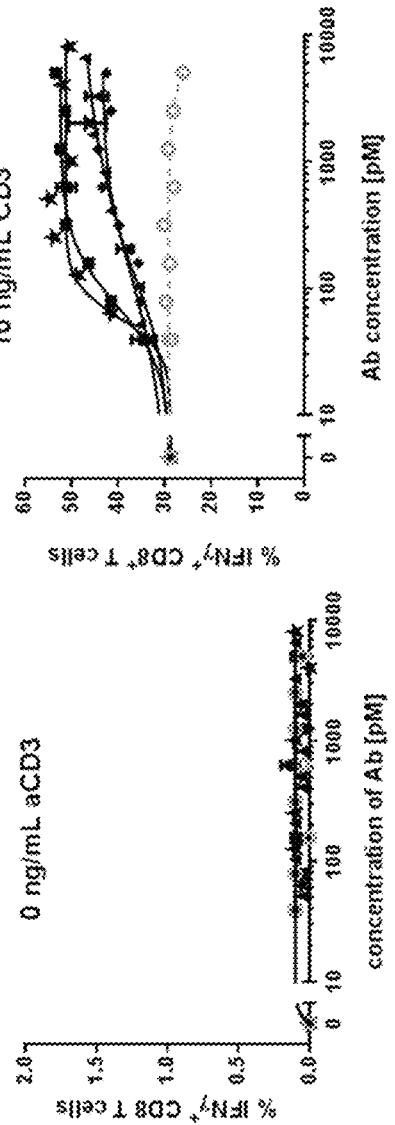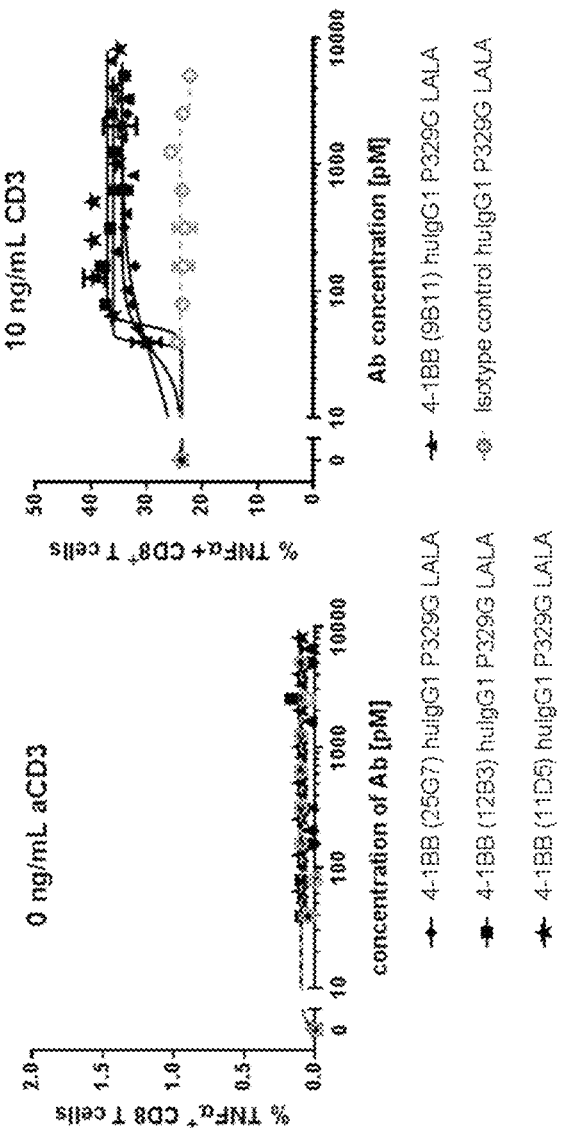

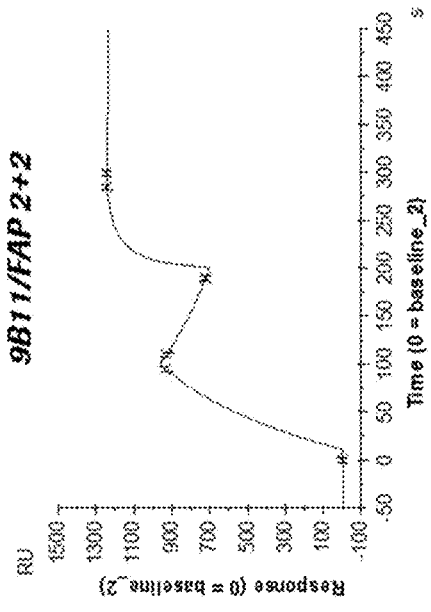
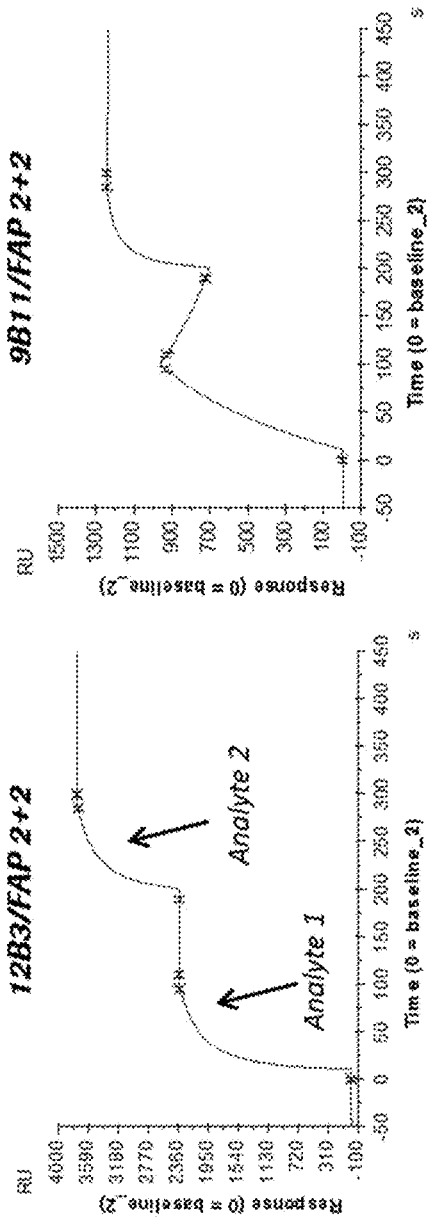
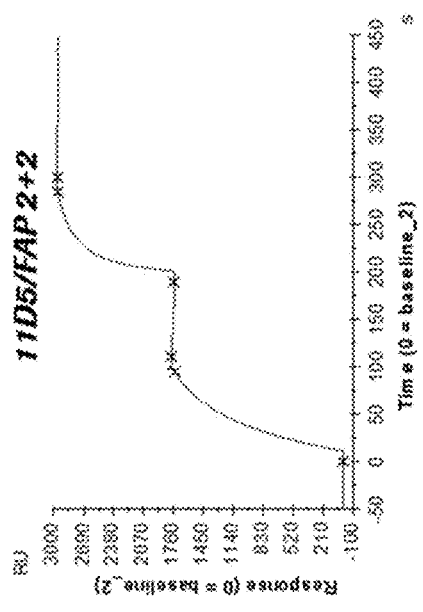
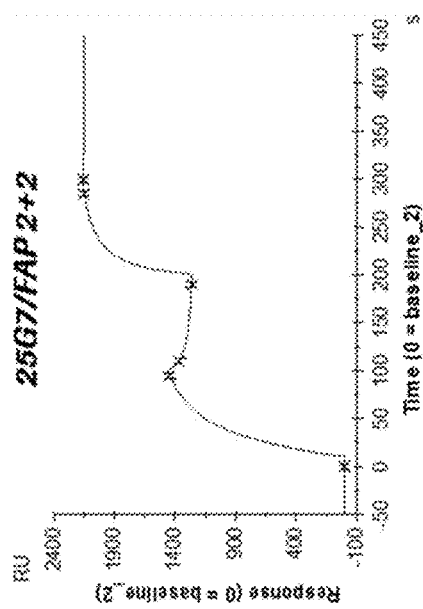

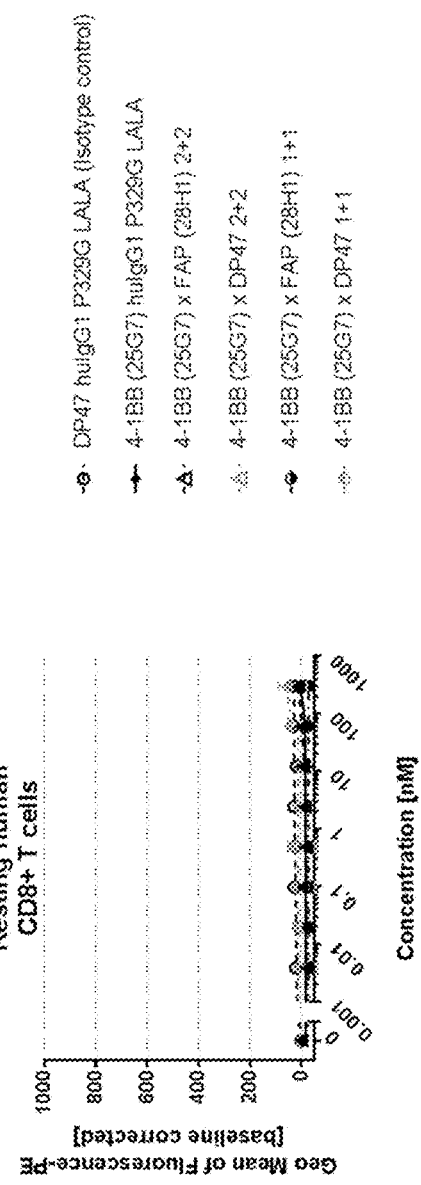
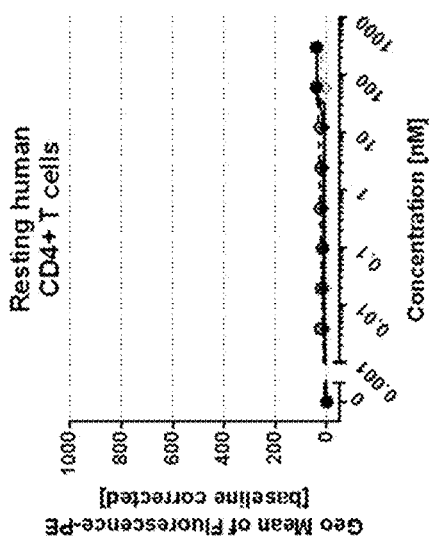
FIG. 38E
FIG. 38F

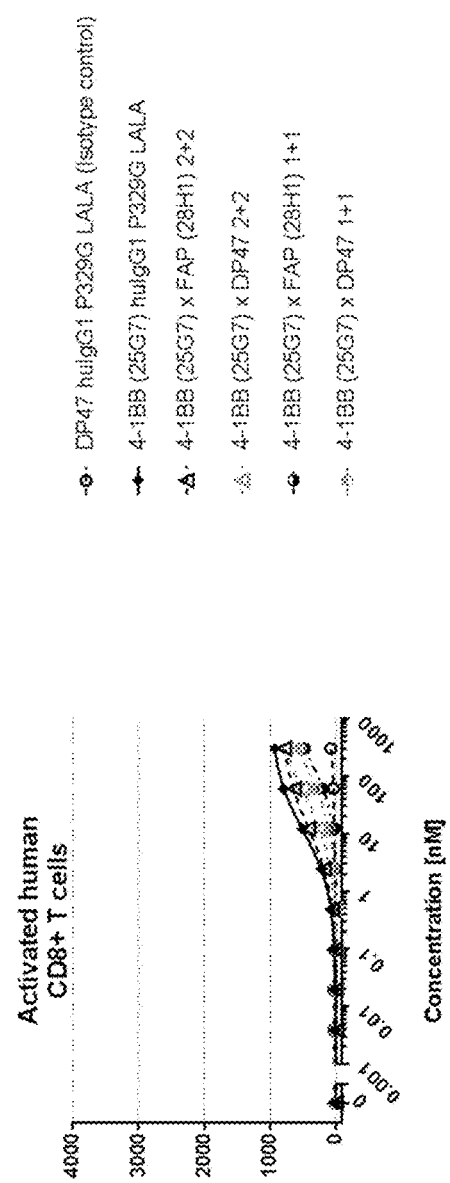
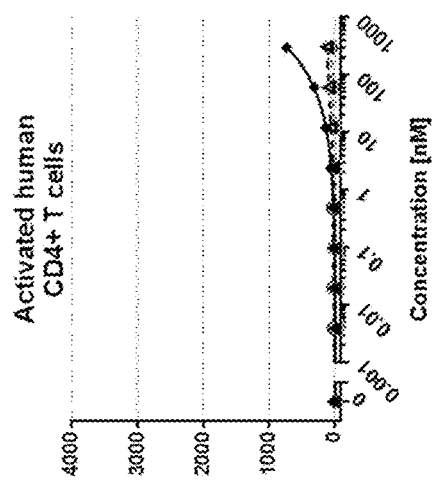
FIG. 39E
FIG. 39F

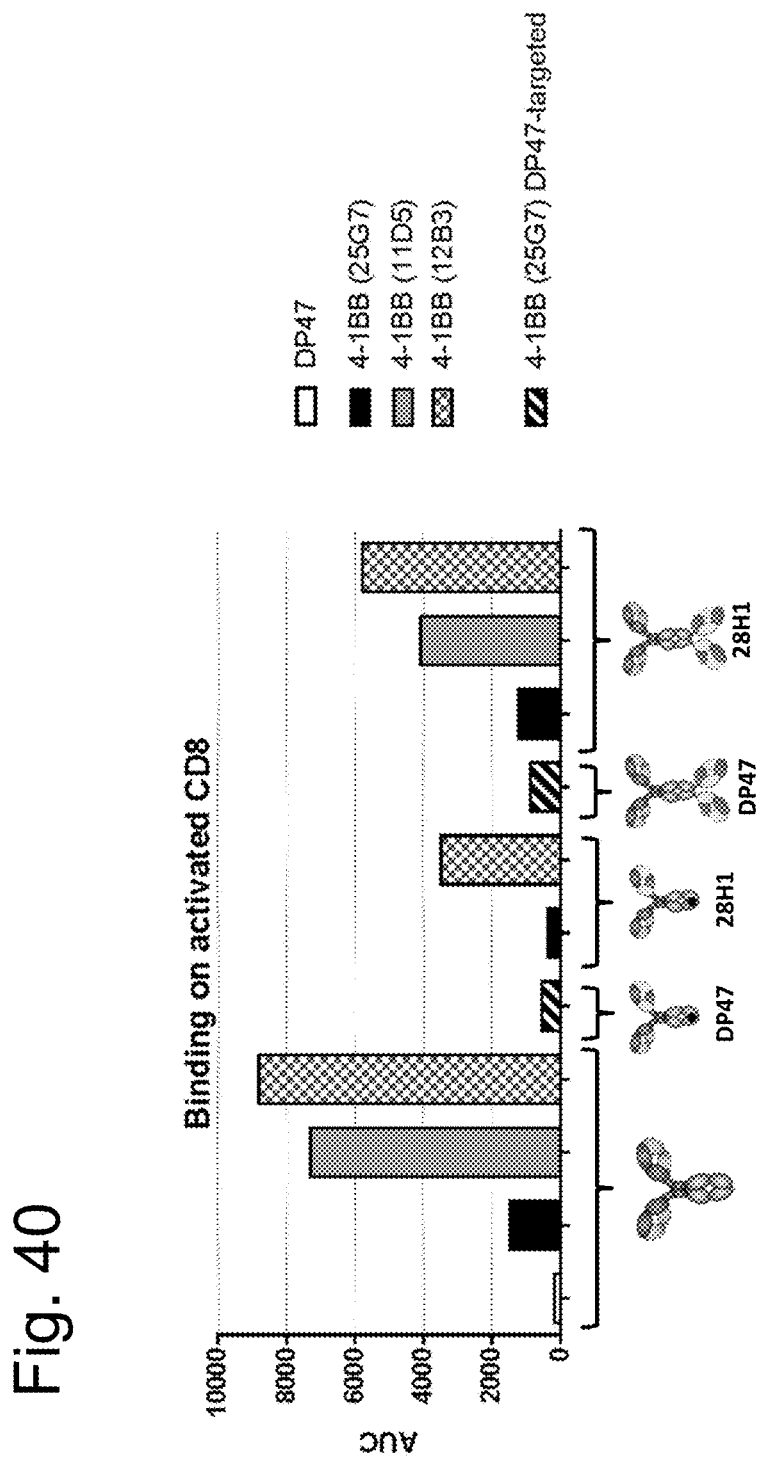

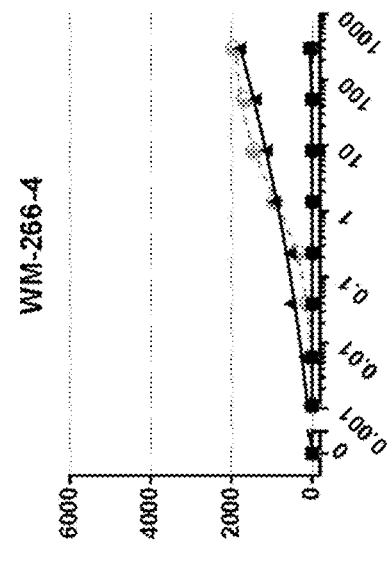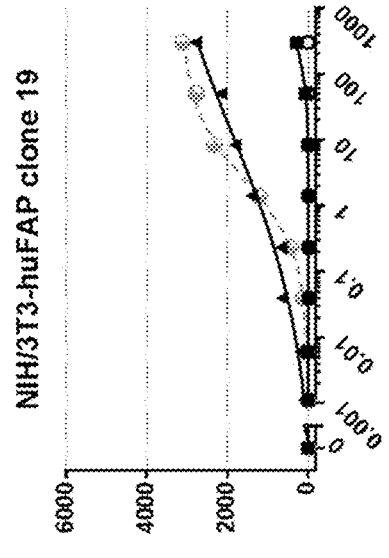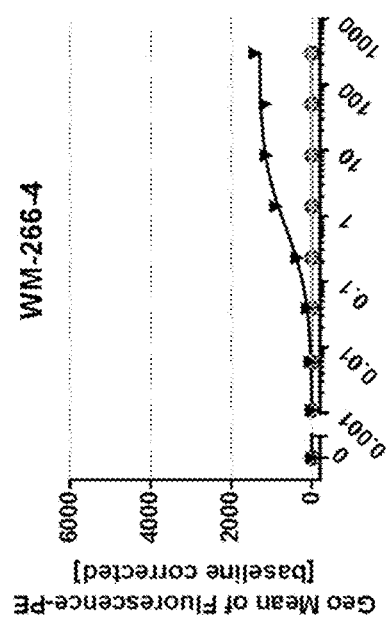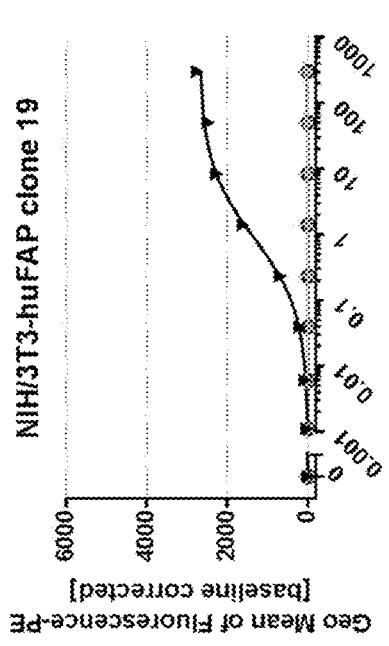

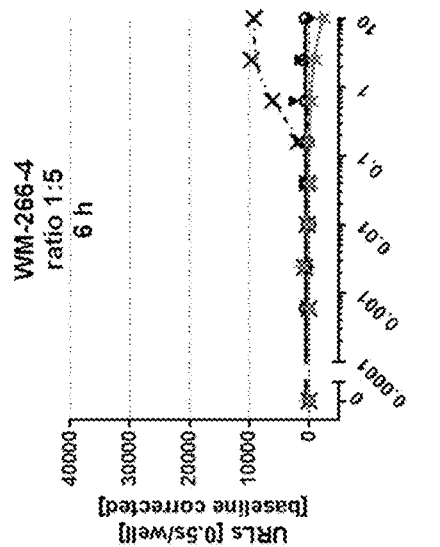
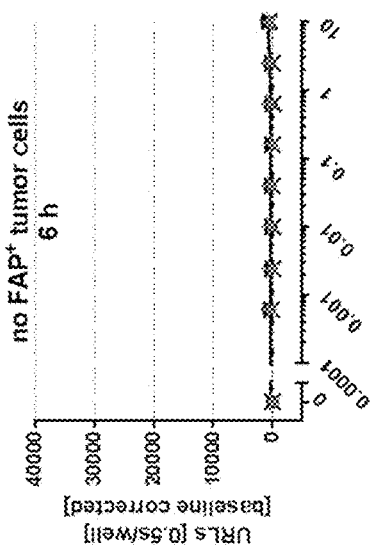
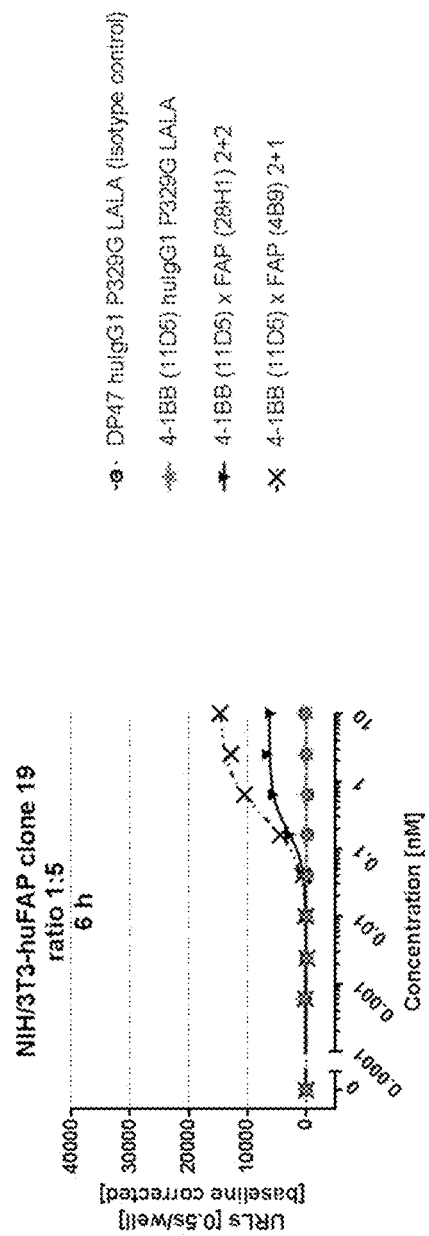
FIG. 43A
FIG. 43B
FIG. 43C

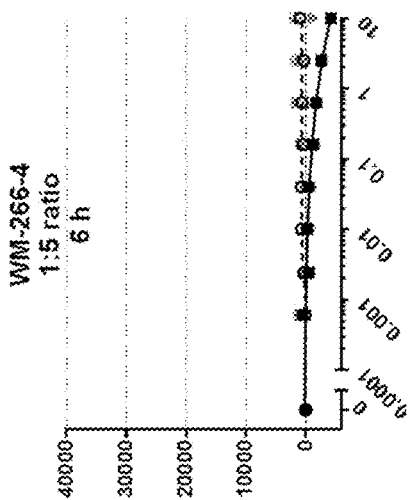
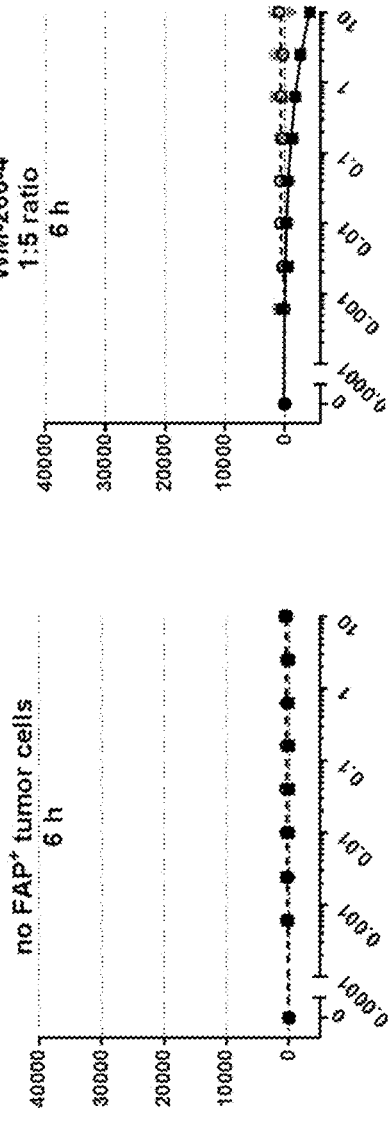
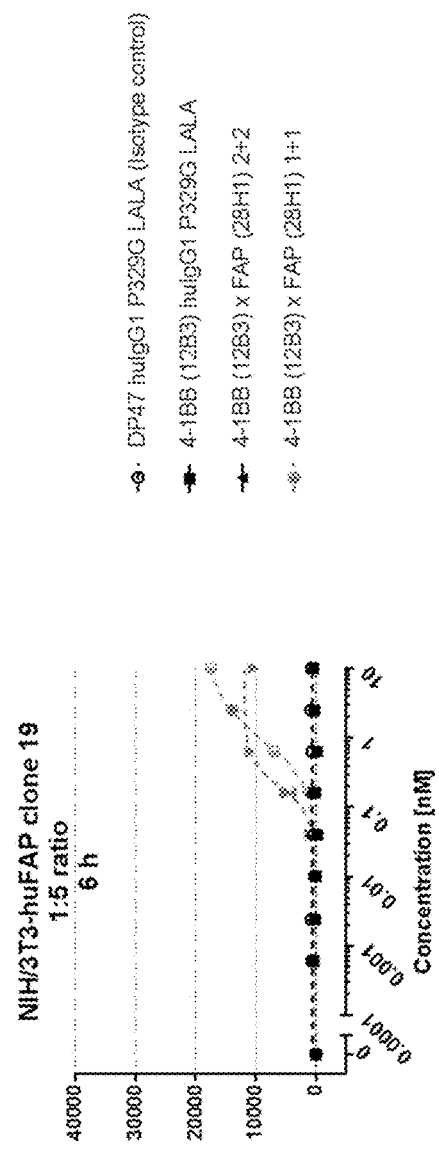

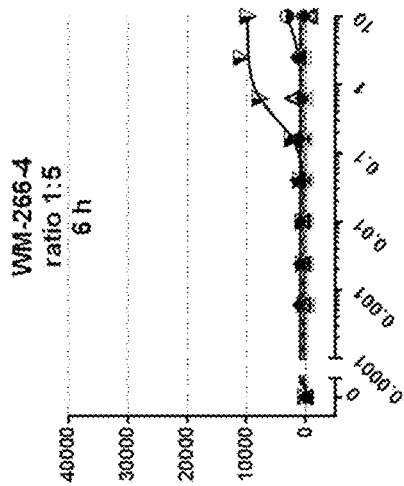
FIG. 43G
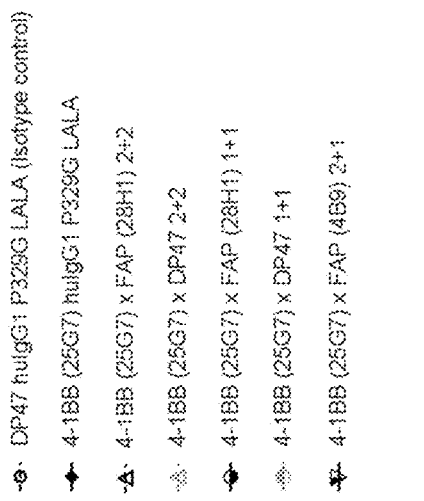
FIG. 43H
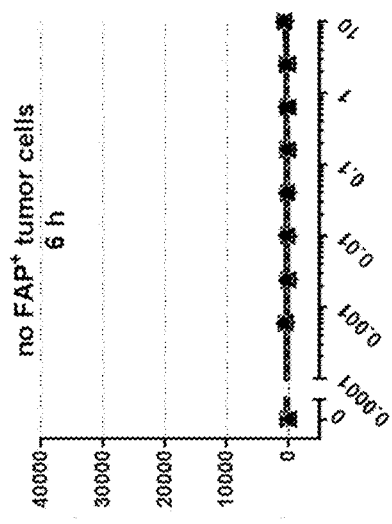
FIG. 43I
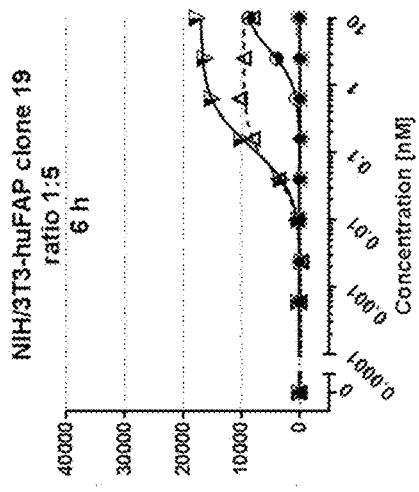

BISPECIFIC ANTIBODIES SPECIFIC FOR OX40

CROSS REFERENCE TO RELATED APPLICATIONS

This application claims the benefit of priority under 35 U.S.C. § 119 to European Patent Application No. 15188095.2, filed Oct. 2, 2015 and European Patent Application No. 16170363.2, filed May 19, 2016, which applications are hereby incorporated by reference in their entirety.

SEQUENCE LISTING

The instant application contains a Sequence Listing submitted via EFS-Web and is hereby incorporated by reference in its entirety. Said ASCII copy, created on Sep. 13, 2016, is named P33116US_SeqList.txt, and is 698,591 bytes in size.

FIELD OF THE INVENTION

The invention relates to novel bispecific antigen binding molecules, comprising (a) at least one moiety capable of specific binding to a costimulatory TNF receptor family member, (b) at least one moiety capable of specific binding to a target cell antigen, and (c) a Fc domain composed of a first and a second subunit capable of stable association. The invention further relates to methods of producing these molecules and to methods of using the same.

BACKGROUND

Several members of the tumor necrosis factor receptor (TNFR) family function after initial T cell activation to sustain T cell responses and thus have pivotal roles in the organization and function of the immune system. CD27, 4-1BB (CD137), OX40 (CD134), HVEM, CD30, and GITR can have costimulatory effects on T cells, meaning that they sustain T-cell responses after initial T cell activation (Watts T. H. (2005) Annu. Rev. Immunol. 23, 23-68). The effects of these costimulatory TNFR family members can often be functionally, temporally, or spatially segregated from those of CD28 and from each other. The sequential and transient regulation of T cell activation/survival signals by different costimulators may function to allow longevity of the response while maintaining tight control of T cell survival. Depending on the disease condition, stimulation via costimulatory TNF family members can exacerbate or ameliorate disease. Despite these complexities, stimulation or blockade of TNFR family costimulators shows promise for several therapeutic applications, including cancer, infectious disease, transplantation, and autoimmunity.

Among several costimulatory molecules, the tumor necrosis factor (TNF) receptor family member OX40 (CD134) plays a key role in the survival and homeostasis of effector and memory T cells (Croft M. et al. (2009), Immunological Reviews 229, 173-191). OX40 (CD134) is expressed in several types of cells and regulates immune responses against infections, tumors and self-antigens and its expression has been demonstrated on the surface of T-cells, NKT-cells and NK-cells as well as neutrophils (Baumann R. et al. (2004), Eur. J. Immunol. 34, 2268-2275) and shown to be strictly inducible or strongly upregulated in response to various stimulatory signals. Functional activity of the molecule has been demonstrated in every OX40-expressing cell type suggesting complex regulation of OX40-mediated activity in vivo. Combined with T-cell receptor triggering, OX40 engagement on T-cells by its natural ligand or agonistic antibodies leads to synergistic activation of the PI3K and NFκB signalling pathways (Song J. et al. (2008) J. Immunology 180(11), 7240-7248). In turn, this results in enhanced proliferation, increased cytokine receptor and cytokine production and better survival of activated T-cells. In addition to its co-stimulatory activity in effector CD4$^+$ or CD8$^+$ T-cells, OX40 triggering has been recently shown to inhibit the development and immunosuppressive function of T regulatory cells. This effect is likely to be responsible, at least in part, for the enhancing activity of OX40 on anti-tumor or anti-microbial immune responses. Given that OX40 engagement can expand T-cell populations, promote cytokine secretion, and support T-cell memory, agonists including antibodies and soluble forms of the ligand OX40L have been used successfully in a variety of preclinical tumor models (Weinberg et al. (2000), J. Immunol. 164, 2160-2169).

4-1BB (CD137), a member of the TNF receptor superfamily, has been first identified as a molecule whose expression is induced by T-cell activation (Kwon Y. H. and Weissman S. M. (1989), Proc. Natl. Acad. Sci. USA 86, 1963-1967). Subsequent studies demonstrated expression of 4-1BB in T- and B-lymphocytes (Snell L. M. et al. (2011) Immunol. Rev. 244, 197-217 or Zhang X. et al. (2010), J. Immunol. 184, 787-795), NK-cells (Lin W. et al. (2008), Blood 112, 699-707, NKT-cells (Kim D. H. et al. (2008), J. Immunol. 180, 2062-2068), monocytes (Kienzle G. and von Kempis J. (2000), Int. Immunol. 12, 73-82, or Schwarz H. et al. (1995), Blood 85, 1043-1052), neutrophils (Heinisch I. V. et al. (2000), Eur. J. Immunol. 30, 3441-3446), mast (Nishimoto H. et al. (2005), Blood 106, 4241-4248), and dendritic cells as well as cells of non-hematopoietic origin such as endothelial and smooth muscle cells (Broll K. et al. (2001), Am. J. Clin. Pathol. 115, 543-549 or Olofsson P. S. et al. (2008), Circulation 117, 1292-1301). Expression of 4-1BB in different cell types is mostly inducible and driven by various stimulatory signals, such as T-cell receptor (TCR) or B-cell receptor triggering, as well as signaling induced through co-stimulatory molecules or receptors of pro-inflammatory cytokines (Diehl L. et al. (2002), J. Immunol. 168, 3755-3762; von Kempis J. et al. (1997), Osteoarthritis Cartilage 5, 394-406; Zhang X. et al. (2010), J. Immunol. 184, 787-795).

CD137 signaling is known to stimulate IFNγ secretion and proliferation of NK cells (Buechele C. et al. (2012), Eur. J. Immunol. 42, 737-748; Lin W. et al. (2008), Blood 112, 699-707; Melero I. et al. (1998), Cell Immunol. 190, 167-172) as well as to promote DC activation as indicated by their increased survival and capacity to secret cytokines and upregulate co-stimulatory molecules (Choi B. K. et al. (2009), J. Immunol. 182, 4107-4115; Futagawa T. et al. (2002), Int. Immunol. 14, 275-286; Wilcox R. A. et al. (2002), J. Immunol. 168, 4262-4267). However, CD137 is best characterized as a co-stimulatory molecule which modulates TCR-induced activation in both the CD4$^+$ and CD8$^+$ subsets of T-cells. In combination with TCR triggering, agonistic 4-1BB-specific antibodies enhance proliferation of T-cells, stimulate lymphokine secretion and decrease sensitivity of T-lymphocytes to activation-induced cells death (Snell L. M. et al. (2011) Immunol. Rev. 244, 197-217). In line with these co-stimulatory effects of 4-1BB antibodies on T-cells in vitro, their administration to tumor bearing mice leads to potent anti-tumor effects in many experimental tumor models (Melero I. et al. (1997), Nat. Med. 3, 682-685; Narazaki H. et al. (2010), Blood 115, 1941-1948). In vivo depletion experiments demonstrated that CD8+ T-cells play the most critical role in anti-tumoral effect of 4-1BB-specific antibodies. However, depending on the tumor model or combination therapy, which includes anti-4-1BB, contributions of other types of cells such as DCs, NK-cells or CD4+ T-cells have been reported (Murillo O. et al. (2009), Eur. J. Immunol. 39, 2424-2436; Stagg J. et al. (2011), Proc. Natl. Acad. Sci. USA 108, 7142-7147).

In addition to their direct effects on different lymphocyte subsets, 4-1BB agonists can also induce infiltration and retention of activated T-cells in the tumor through 4-1BB-mediated upregulation of intercellular adhesion molecule 1 (ICAM1) and vascular cell adhesion molecule 1 (VCAM1) on tumor vascular endothelium (Palazon A. et al. (2011), Cancer Res. 71, 801-811). 4-1BB triggering may also reverse the state of T-cell anergy induced by exposure to soluble antigen that may contribute to disruption of immunological tolerance in the tumor micro-environment or during chronic infections (Wilcox R. A. et al. (2004), Blood 103, 177-184).

It appears that the immunomodulatory properties of 4-1BB agonistic antibodies in vivo require the presence of the wild type Fc-portion on the antibody molecule thereby implicating Fc-receptor binding as an important event required for the pharmacological activity of such reagents as has been described for agonistic antibodies specific to other apoptosis-inducing or immunomodulatory members of the TNFR-superfamily (Li F. and Ravetch J. V. (2011), Science 333, 1030-1034; Teng M. W. et al. (2009), J. Immunol. 183, 1911-1920). However, systemic administration of 4-1BB-specific agonistic antibodies with the functionally active Fc domain also induces expansion of CD8+ T-cells associated with liver toxicity (Dubrot J. et al. (2010), Cancer Immunol. Immunother. 59, 1223-1233) that is diminished or significantly ameliorated in the absence of functional Fc-receptors in mice. In human clinical trials (ClinicalTrials.gov, NCT00309023), Fc-competent 4-1BB agonistic antibodies (BMS-663513) administered once every three weeks for 12 weeks induced stabilization of the disease in patients with melanoma, ovarian or renal cell carcinoma. However, the same antibody given in another trial (NCT00612664) caused grade 4 hepatitis leading to termination of the trial (Simeone E. and Ascierto P. A. (2012), J. Immunotoxicology 9, 241-247). Thus, there is a need for new generation agonists that should not only effectively engage 4-1BB on the surface of hematopoietic and endothelial cells but also be capable of achieving that through mechanisms other than binding to Fc-receptors in order to avoid uncontrollable side effects.

The available pre-clinical and clinical data clearly demonstrate that there is a high clinical need for effective agonists of costimulatory TNFR family members such as Ox40 and 4-1BB that are able to induce and enhance effective endogenous immune responses to cancer. However, almost never are the effects limited to a single cell type or acting via a single mechanism and studies designed to elucidate inter- and intracellular signaling mechanisms have revealed increasing levels of complexity. Thus, there is a need of "targeted" agonists that preferably act on a single cell type. The antigen binding molecules of the invention combine a moiety capable of preferred binding to tumor-specific or tumor-associated targets with a moiety capable of agonistic binding to costimulatory TNF receptors. The antigen binding molecules of this invention may be able to trigger TNF receptors not only effectively, but also very selectively at the desired site thereby reducing undesirable side effects.

SUMMARY OF THE INVENTION

The present invention relates to bispecific antigen binding molecules combining at least one moiety capable of specific binding to a costimulatory TNF receptor family member, i.e at least one antigen binding site that targets costimulatory TNF receptors with at least one moiety capable of specific binding to a target cell antigen, i.e. with at least one antigen binding side targeting a target cell antigen. These bispecific antigen binding molecules are advantageous as they will preferably activate costimulatory TNF receptors at the site where the target cell antigen is expressed, due to their binding capability towards a target cell antigen. The invention also provides novel antibodies capable of specific binding to a costimulatory TNF receptor family member. In comparison to known antibodies to costimulatory TNF receptors these antibodies have properties that are advantageous for incorporating them into bispecific antigen binding molecules in combination with moieties capable of specific binding to a target cell antigen.

In one aspect, the invention provides a bispecific antigen binding molecule, comprising
(a) at least one moiety capable of specific binding to a costimulatory TNF receptor family member,
(b) at least one moiety capable of specific binding to a target cell antigen, and
(c) a Fc domain composed of a first and a second subunit capable of stable association.

In a particular aspect, the bispecific antigen binding molecule comprises (a) at least one moiety capable of specific binding to a costimulatory TNF receptor family member, wherein the costimulatory TNF receptor family member is selected from the group consisting of OX40 and 4-1BB, (b) at least one moiety capable of specific binding to a target cell antigen, and (c) a Fc domain composed of a first and a second subunit capable of stable association.

In one aspect, the costimulatory TNF receptor family member is OX40. Thus, in a particular aspect, the moiety capable of specific binding to a costimulatory TNF receptor family member binds to a polypeptide comprising the amino acid sequence of SEQ ID NO:1.

In a further aspect, provided is a bispecific antigen binding molecule, comprising at least one moiety capable of specific binding to OX40, wherein said moiety comprises a VH domain comprising
  (i) a CDR-H1 comprising the amino acid sequence selected from the group consisting of SEQ ID NO:2 and SEQ ID NO:3,
  (ii) a CDR-H2 comprising the amino acid sequence selected from the group consisting of SEQ ID NO:4 and SEQ ID NO:5, and
  (iii) a CDR-H3 comprising the amino acid sequence selected from the group consisting of SEQ ID NO:6, SEQ ID NO:7, SEQ ID NO:8, SEQ ID NO: 9, SEQ ID NO:10, SEQ ID NO:11 and SEQ ID NO:12,
and a VL domain comprising
  (iv) a CDR-L1 comprising the amino acid sequence selected from the group consisting of SEQ ID NO:13, SEQ ID NO:14 and SEQ ID NO:15,
  (v) a CDR-L2 comprising the amino acid sequence selected from the group consisting of SEQ ID NO:16, SEQ ID NO:17 and SEQ ID NO:18, and
  (vi) a CDR-L3 comprising the amino acid sequence selected from the group consisting of SEQ ID NO:19, SEQ ID NO:20, SEQ ID NO:21, SEQ ID NO:22, SEQ ID NO:23 and SEQ ID NO:24.

In another aspect, the invention provides a bispecific antigen binding molecule, wherein the moiety capable of specific binding to OX40 comprises a heavy chain variable region VH comprising an amino acid sequence that is at least about 95%, 96%, 97%, 98%, 99% or 100% identical to an amino acid sequence selected from the group consisting of SEQ ID NO:25, SEQ ID NO: 27, SEQ ID NO:29, SEQ ID NO:31, SEQ ID NO:33, SEQ ID NO:35 and SEQ ID NO:37 and a light chain variable region VL comprising an amino acid sequence that is at least about 95%, 96%, 97%, 98%, 99% or 100% identical to an amino acid sequence of SEQ ID NO:26, SEQ ID NO: 28, SEQ ID NO:30, SEQ ID NO:30, SEQ ID NO:32, SEQ ID NO:34, SEQ ID NO:36 and SEQ ID NO:38.

Particularly, a bispecific antigen binding molecule is provided, wherein the moiety capable of specific binding to OX40 comprises
- (i) a heavy chain variable region VH comprising an amino acid sequence of SEQ ID NO:25 and and a light chain variable region VL comprising an amino acid sequence of SEQ ID NO:26,
- (ii) a heavy chain variable region VH comprising an amino acid sequence of SEQ ID NO:27 and and a light chain variable region VL comprising an amino acid sequence of SEQ ID NO:28,
- (iii) a heavy chain variable region VH comprising an amino acid sequence of SEQ ID NO:29 and and a light chain variable region VL comprising an amino acid sequence of SEQ ID NO:30,
- (iv) a heavy chain variable region VH comprising an amino acid sequence of SEQ ID NO:31 and and a light chain variable region VL comprising an amino acid sequence of SEQ ID NO:32,
- (v) a heavy chain variable region VH comprising an amino acid sequence of SEQ ID NO:33 and and a light chain variable region VL comprising an amino acid sequence of SEQ ID NO:34,
- (vi) a heavy chain variable region VH comprising an amino acid sequence of SEQ ID NO:35 and and a light chain variable region VL comprising an amino acid sequence of SEQ ID NO:36, or
- (vii) a heavy chain variable region VH comprising an amino acid sequence of SEQ ID NO:37 and and a light chain variable region VL comprising an amino acid sequence of SEQ ID NO:38.

In another aspect, the costimulatory TNF receptor family member is 4-1BB. Thus, in a particular aspect, the moiety capable of specific binding to a costimulatory TNF receptor family member binds to a polypeptide comprising the amino acid sequence of SEQ ID NO:39.

Furthermore, provided is a bispecific antigen binding molecule, comprising at least one moiety capable of specific binding to 4-1BB, wherein said moiety comprises a VH domain comprising
- (i) a CDR-H1 comprising the amino acid sequence selected from the group consisting of SEQ ID NO:40 and SEQ ID NO:41,
- (ii) a CDR-H2 comprising the amino acid sequence selected from the group consisting of SEQ ID NO:42 and SEQ ID NO:43, and
- (iii) a CDR-H3 comprising the amino acid sequence selected from the group consisting of SEQ ID NO:44, SEQ ID NO:45, SEQ ID NO:46, SEQ ID NO:47 and SEQ ID NO:48 and a VL domain comprising
- (iv) a CDR-L1 comprising the amino acid sequence selected from the group consisting of SEQ ID NO:49 and SEQ ID NO:50,
- (v) a CDR-L2 comprising the amino acid sequence selected from the group consisting of SEQ ID NO:51 and SEQ ID NO:52, and
- (vi) a CDR-L3 comprising the amino acid sequence selected from the group consisting of SEQ ID NO:53, SEQ ID NO:54, SEQ ID NO:55, SEQ ID NO:56 and SEQ ID NO:57.

In another aspect, the invention provides a bispecific antigen binding molecule, wherein the moiety capable of specific binding to 4-1BB comprises a heavy chain variable region VH comprising an amino acid sequence that is at least about 95%, 96%, 97%, 98%, 99% or 100% identical to an amino acid sequence selected from the group consisting of SEQ ID NO:58, SEQ ID NO:60, SEQ ID NO:62, SEQ ID NO:64 and SEQ ID NO:66 and a light chain variable region comprising an amino acid sequence that is at least about 95%, 96%, 97%, 98%, 99% or 100% identical to an amino acid sequence selected from the group consisting of SEQ ID NO:59, SEQ ID NO:61, SEQ ID NO:63, SEQ ID NO:65 and SEQ ID NO:67.

Particularly, a bispecific antigen binding molecule is provided, wherein the moiety capable of specific binding to 4-1BB comprises
- (i) a heavy chain variable region VH comprising an amino acid sequence of SEQ ID NO:58 and and a light chain variable region VL comprising an amino acid sequence of SEQ ID NO:59,
- (ii) a heavy chain variable region VH comprising an amino acid sequence of SEQ ID NO:60 and and a light chain variable region VL comprising an amino acid sequence of SEQ ID NO:61,
- (iii) a heavy chain variable region VH comprising an amino acid sequence of SEQ ID NO:62 and and a light chain variable region VL comprising an amino acid sequence of SEQ ID NO:63,
- (iv) a heavy chain variable region VH comprising an amino acid sequence of SEQ ID NO:64 and and a light chain variable region VL comprising an amino acid sequence of SEQ ID NO:65, or
- (v) a heavy chain variable region VH comprising an amino acid sequence of SEQ ID NO:66 and and a light chain variable region VL comprising an amino acid sequence of SEQ ID NO:67.

In a particular aspect, the invention provides a bispecific antigen binding molecule, comprising
- (a) at least one moiety capable of specific binding to a costimulatory TNF receptor family member,
- (b) at least one moiety capable of specific binding to a target cell antigen, and
- (c) a Fc domain composed of a first and a second subunit capable of stable association, wherein the moiety capable of specific binding to a costimulatory TNF receptor family member is a Fab fragment. In one aspect, if the bispecific antigen binding molecule, comprises more than one moiety capable of specific binding to a costimulatory TNF receptor family member, all moieties capable of specific binding to a costimulatory TNF receptor family member are Fab fragments.

In another aspect, the bispecific antigen binding molecule comprises (a) at least one moiety capable of specific binding to a costimulatory TNF receptor family member, (b) at least one moiety capable of specific binding to a target cell antigen, wherein the target cell antigen is selected from the group consisting of Fibroblast Activation Protein (FAP), Melanoma-associated Chondroitin Sulfate Proteoglycan (MCSP), Epidermal Growth Factor Receptor (EGFR), Carcinoembryonic Antigen (CEA), CD19, CD20 and CD33, and (c) a Fc domain composed of a first and a second subunit capable of stable association. More particularly, the target cell antigen is Fibroblast Activation Protein (FAP).

In a particular aspect, provided is a bispecific antigen binding molecule, wherein the moiety capable of specific binding to FAP comprises a VH domain comprising
  (i) a CDR-H1 comprising the amino acid sequence selected from the group consisting of SEQ ID NO:68 and SEQ ID NO:69,
  (ii) a CDR-H2 comprising the amino acid sequence selected from the group consisting of SEQ ID NO:70 and SEQ ID NO:71, and
  (iii) a CDR-H3 comprising the amino acid sequence selected from the group consisting of SEQ ID NO:72 and SEQ ID NO:73,
and a VL domain comprising
  (iv) a CDR-L1 comprising the amino acid sequence selected from the group consisting of SEQ ID NO:74 and SEQ ID NO:75,
  (v) a CDR-L2 comprising the amino acid sequence selected from the group consisting of SEQ ID NO:76 and SEQ ID NO:77, and
  (vi) a CDR-L3 comprising the amino acid sequence selected from the group consisting of SEQ ID NO:78 and SEQ ID NO:79.

In a further aspect, the invention thus provides a bispecific antigen binding molecule, wherein
(i) the moiety capable of specific binding to OX40 comprises a heavy chain variable region VH comprising an amino acid sequence that is at least about 95%, 96%, 97%, 98%, 99% or 100% identical to the amino acid sequence of SEQ ID NO:25, SEQ ID NO: 27, SEQ ID NO:29, SEQ ID NO:31, SEQ ID NO:33, SEQ ID NO:35 or SEQ ID NO:37 and a light chain variable region comprising an amino acid sequence that is at least about 95%, 96%, 97%, 98%, 99% or 100% identical to the amino acid sequence of SEQ ID NO:26, SEQ ID NO: 28, SEQ ID NO:30, SEQ ID NO:32, SEQ ID NO:34, SEQ ID NO:36 or SEQ ID NO:38 and
(ii) the moiety capable of specific binding to FAP comprises a heavy chain variable region VH comprising an amino acid sequence that is at least about 95%, 96%, 97%, 98%, 99% or 100% identical to the amino acid sequence of SEQ ID NO:80 or SEQ ID NO:82 and a light chain variable region comprising an amino acid sequence that is at least about 95%, 96%, 97%, 98%, 99% or 100% identical to the amino acid sequence of SEQ ID NO:81 or SEQ ID NO:83.

In one aspect, the invention provides a bispecific antigen binding molecule, wherein
(i) the moiety capable of specific binding to OX40 comprises a heavy chain variable region VH comprising the amino acid sequence of SEQ ID NO: 27 and a light chain variable region comprising an amino acid sequence of SEQ ID NO: 28 and
(ii) the moiety capable of specific binding to FAP comprises a heavy chain variable region VH comprising an amino acid sequence of SEQ ID NO:82 and a light chain variable region comprising an amino acid sequence of SEQ ID NO:83. In another aspect, the invention provides a bispecific antigen binding molecule, wherein
(i) the moiety capable of specific binding to 4-1BB comprises a heavy chain variable region VH comprising an amino acid sequence that is at least about 95%, 96%, 97%, 98%, 99% or 100% identical to the amino acid sequence of SEQ ID NO:58, SEQ ID NO:60, SEQ ID NO:62, SEQ ID NO:64 or SEQ ID NO:66 and a light chain variable region comprising an amino acid sequence that is at least about 95%, 96%, 97%, 98%, 99% or 100% identical to the amino acid sequence of SEQ ID NO:59, SEQ ID NO:61, SEQ ID NO:63, SEQ ID NO:65 or SEQ ID NO:67 and
(ii) the moiety capable of specific binding to FAP comprises a heavy chain variable region VH comprising an amino acid sequence that is at least about 95%, 96%, 97%, 98%, 99% or 100% identical to the amino acid sequence of SEQ ID NO:80 or SEQ ID NO:82 and a light chain variable region comprising an amino acid sequence that is at least about 95%, 96%, 97%, 98%, 99% or 100% identical to the amino acid sequence of SEQ ID NO:81 or SEQ ID NO:83.

In a further aspect, provided is a bispecific antigen binding molecule, wherein said molecule comprises
(a) a first Fab fragment capable of specific binding to a costimulatory TNF receptor family member,
(b) a second Fab fragment capable of specific binding to a target cell antigen, and
(c) a Fc domain composed of a first and a second subunit capable of stable association.

In one aspect, the bispecific antigen binding molecule is a human, a humanized or a chimeric antibody. In particular, the Fc domain is a human IgG domain, particularly an IgG1 Fc domain or an IgG4 Fc domain.

In a further aspect, provided is a bispecific antigen binding molecule, wherein the Fc domain comprises one or more amino acid substitution that reduces the binding affinity of the antibody to an Fc receptor and/or effector function. In particular, the Fc domain is of human IgG1 subclass with the amino acid mutations L234A, L235A and P329G (numbering according to Kabat EU index).

In a further aspect, provided is a bispecific antigen binding molecule, wherein the Fc domain comprises a modification promoting the association of the first and second subunit of the Fc domain. In a particular aspect, the invention provides a bispecific antigen binding molecule, wherein the first subunit of the Fc domain comprises knobs and the second subunit of the Fc domain comprises holes according to the knobs into holes method. More particularly, the first subunit of the Fc domain comprises the amino acid substitutions S354C and T366W (numbering according to Kabat EU index) and the second subunit of the Fc domain comprises the amino acid substitutions Y349C, T366S and Y407V (numbering according to Kabat EU index).

In particular the invention provides a bispecific antigen binding molecule, comprising
(a) two moieties capable of specific binding to a costimulatory TNF receptor family member,
(b) two moieties capable of specific binding to a target cell antigen, and
(c) a Fc domain composed of a first and a second subunit capable of stable association.

Thus, provided is a bispecific antigen binding molecule, wherein the bispecific antigen binding molecule is bivalent both for the costimulatory TNF receptor family member and for the target cell antigen.

In a particular aspect, the bispecific antigen binding molecule comprises
(a) two light chains and two heavy chains of an antibody comprising two Fab fragments capable of specific binding to a costimulatory TNF receptor family member and the Fc domain, and
(b) two additional Fab fragments capable of specific binding to a target cell antigen, wherein said additional Fab fragments are each connected via a peptide linker to the C-terminus of the heavy chains of (a). More particularly, the two additional Fab fragments capable of specific binding to a target cell antigen are cross-Fab fragments wherein the variable domains VL and VH are replaced by each other and the VL-CH chains are each connected via a peptide linker to the C-terminus of the heavy chains of (a).

In one aspect, the two Fab fragments capable of specific binding to a costimulatory TNF receptor family member are two Fab fragments capable of specific binding to OX40 or 4-1BB and the two additional Fab fragments capable of specific binding to a target cell antigen are cross-Fab fragments capable of specific binding to FAP.

In another aspect, the invention provides a bispecific antigen binding molecule comprising
(a) two moieties capable of specific binding to a costimulatory TNF receptor family member,
(b) one moiety capable of specific binding to a target cell antigen, and
(c) a Fc domain composed of a first and a second subunit capable of stable association.

Thus, provided is a bispecific antigen binding molecule, wherein the bispecific antigen binding molecule is bivalent for the costimulatory TNF receptor family member and monovalent for the target cell antigen.

In a particular aspect, the bispecific antigen binding molecule comprises
(a) two light chains and two heavy chains of an antibody comprising two Fab fragments capable of specific binding to a costimulatory TNF receptor family member and the Fc domain, and
(b) a VH and VL domain capable of specific binding to a target cell antigen, wherein the VH domain is connected via a peptide linker to the C-terminus of one of the heavy chains and wherein the VL domain is connected via a peptide linker to the C-terminus of the second heavy chain.

In another aspect, the invention provides an antibody that specifically binds to OX40, wherein said antibody comprises
  (i) a heavy chain variable region VH comprising an amino acid sequence of SEQ ID NO:25 and and a light chain variable region VL comprising an amino acid sequence of SEQ ID NO:26,
  (ii) a heavy chain variable region VH comprising an amino acid sequence of SEQ ID NO:27 and and a light chain variable region VL comprising an amino acid sequence of SEQ ID NO:28,
  (iii) a heavy chain variable region VH comprising an amino acid sequence of SEQ ID NO:29 and and a light chain variable region VL comprising an amino acid sequence of SEQ ID NO:30,
  (iv) a heavy chain variable region VH comprising an amino acid sequence of SEQ ID NO:31 and and a light chain variable region VL comprising an amino acid sequence of SEQ ID NO:32,
  (v) a heavy chain variable region VH comprising an amino acid sequence of SEQ ID NO:33 and and a light chain variable region VL comprising an amino acid sequence of SEQ ID NO:34,
  (vi) a heavy chain variable region VH comprising an amino acid sequence of SEQ ID NO:35 and and a light chain variable region VL comprising an amino acid sequence of SEQ ID NO:36, or
  (vii) a heavy chain variable region VH comprising an amino acid sequence of SEQ ID NO:37 and and a light chain variable region VL comprising an amino acid sequence of SEQ ID NO:38.

In yet another aspect, provided is an antibody that specifically binds to 4-1BB, wherein said antibody comprises
  (i) a heavy chain variable region VH comprising an amino acid sequence of SEQ ID NO:58 and and a light chain variable region VL comprising an amino acid sequence of SEQ ID NO:59,
  (ii) a heavy chain variable region VH comprising an amino acid sequence of SEQ ID NO:60 and and a light chain variable region VL comprising an amino acid sequence of SEQ ID NO:61,
  (iii) a heavy chain variable region VH comprising an amino acid sequence of SEQ ID NO:62 and and a light chain variable region VL comprising an amino acid sequence of SEQ ID NO:63,
  (iv) a heavy chain variable region VH comprising an amino acid sequence of SEQ ID NO:64 and and a light chain variable region VL comprising an amino acid sequence of SEQ ID NO:65, or
  (v) a heavy chain variable region VH comprising an amino acid sequence of SEQ ID NO:66 and and a light chain variable region VL comprising an amino acid sequence of SEQ ID NO:67.

According to another aspect of the invention, there is provided an isolated polynucleotide encoding a bispecific antigen binding molecule as described herein before or an antibody that specifically binds to OX40 as described herein before or an antibody that specifically binds to 4-1BB as described herein before. The invention further provides a vector, particularly an expression vector, comprising the isolated polynucleotide of the invention and a host cell comprising the isolated polynucleotide or the vector of the invention. In some aspects the host cell is a eukaryotic cell, particularly a mammalian cell.

In another aspect, provided is a method for producing a bispecific antigen binding molecule as described herein before or an antibody that specifically binds to OX40 as described herein before or an antibody that specifically binds to 4-1BB as described herein before, comprising the steps of (i) culturing the host cell of the invention under conditions suitable for expression of the antigen binding molecule, and (ii) recovering the antigen binding molecule. The invention also encompasses the bispecific antigen binding molecule or the antibody that specifically binds to OX40 or the antibody that specifically binds to 4-1BB produced by the method of the invention.

The invention further provides a pharmaceutical composition comprising a bispecific antigen binding molecule as described herein before or an antibody that specifically binds to OX40 as described herein before or an antibody that specifically binds to 4-1BB as described herein before and at least one pharmaceutically acceptable excipient.

Also encompassed by the invention is the bispecific antigen binding molecule as described herein before or the antibody that specifically binds to OX40 as described herein before or the antibody that specifically binds to 4-1BB as described herein before, or the pharmaceutical composition comprising the bispecific antigen binding molecule or the antibody that specifically binds to OX40 or the antibody that specifically binds to 4-1BB, for use as a medicament.

In one aspect, provided is a bispecific antigen binding molecule as described herein before or an antibody that specifically binds to OX40 as described herein before or an antibody that specifically binds to 4-1BB as described herein before or the pharmaceutical composition of the invention, for use
  (i) in stimulating T cell response,
  (ii) in supporting survival of activated T cells,
  (iii) in the treatment of infections,
  (iv) in the treatment of cancer, (v) in delaying progression of cancer, or
(vi) in prolonging the survival of a patient suffering from cancer.

In a specific embodiment, provided is the bispecific antigen binding molecule as described herein before or the antibody that specifically binds to OX40 as described herein before or the antibody that specifically binds to 4-1BB as described herein before, or the pharmaceutical composition of the invention, for use in the treatment of cancer.

In another specific aspect, the invention provides the bispecific antigen binding molecule as described herein before or the antibody that specifically binds to OX40 as described herein before or the antibody that specifically binds to 4-1BB as described herein for use in the treatment of cancer, wherein the bispecific antigen binding molecule is administered in combination with a chemotherapeutic agent, radiation and/or other agents for use in cancer immunotherapy.

In a further aspect, the invention provides a method of inhibiting the growth of tumor cells in an individual comprising administering to the individual an effective amount of the bispecific antigen binding molecule as described herein before or the antibody that specifically binds to OX40 as described herein before or the antibody that specifically binds to 4-1BB as described herein before, or the pharmaceutical composition of the invention, to inhibit the growth of the tumor cells.

Also provided is the use of the bispecific antigen binding molecule as described herein before or the antibody that specifically binds to OX40 as described herein before or the antibody that specifically binds to 4-1BB as described herein before for the manufacture of a medicament for the treatment of a disease in an individual in need thereof, in particular for the manufacture of a medicament for the treatment of cancer, as well as a method of treating a disease in an individual, comprising administering to said individual a therapeutically effective amount of a composition comprising the TNF family ligand trimer-containing antigen binding molecule of the invention in a pharmaceutically acceptable form. In a specific aspect, the disease is cancer. In any of the above aspects the individual is a mammal, particularly a human.

BRIEF DESCRIPTION OF THE DRAWINGS

FIGS. 3A, 3B, 3C and 3D show the binding of the anti-OX40 antibodies to activated mouse CD4$^+$ and CD8$^+$ T cells. OX40 was not detected on resting mouse splencoytes (FIGS. 3A and 3C). After activation OX40 is up-regulated on CD4$^+$ and CD8$^+$ T cells (FIGS. 3B and 3D). Mouse splenocytes were isolated by erythrolysis with ACK lysis buffer of mechanically-homogenized spleens obtained from 6-8 weeks old female C57BL/6 mice. Binding of anti-OX40 antibodies to cell surface proteins was detected with a goat anti-human IgG Fc-specific secondary antibody conjugated to FITC using FACS analysis. MFI was measured by flow cytometry and baseline corrected by subtracting the MFI of the blank control. The x-axis shows the concentration of antibody constructs. Only clone 20B7 does bind to activated, OX40 expressing mouse CD4 and CD8 T Cells, but not to resting T cells.

FIGS. 6A, 6B, 6C, 6D, 6E and 6F show the interaction between anti-Ox40 antibodies 8H9 (FIG. 6A), 20B7 (FIG. 6B), 1G4 (FIG. 6C), 49B4 (FIG. 6D), CLC-563 (FIG. 6E) and CLC-564 (FIG. 6F) and the preformed complex huOx40 Ligand/huOx40-Fc as measured by surface plasmon resonance.

FIGS. 8A, 8B, 8C, 8D, 8E and 8F show the bioactivity of the anti-human OX40 antibodies in preactivated human CD4 T cells. Costimulation with plate-immobilized anti-Ox40 binders (huIgG1 P329GLALA format) promoted cell proliferation and maturation of sub-optimally restimulated human CD4 T cells and induced an enhanced activated phenotype. PHA-L pre-activated CFSE-labeled human CD4 T cells were cultured for four days on plates pre-coated with mouse IgG Fcγ specific antibodies, human IgG Fcγ specific antibodies (both 2 µg/mL), mouse anti-human CD3 antibodies (clone OKT3, [3 ng/mL]) and titrated anti-Ox40 binders (huIgG1 P329GLALA format). Shown is the event count (FIG. 8A), the percentage of proliferating (CFSE-low) cells (FIG. 8B), the percentage of effector T cells (CD127 low/CD45RA low) (FIG. 8C) and the percentage of CD62L low (FIG. 8D), OX40 positive (FIG. 8F) or Tim-3 positive cells (FIG. 8E) at day 4. Baseline values of samples containing only the plate-immobilized anti-human CD3 were substracted. Therefore, the enhancing effect of OX40 stimulation but not the effect of suboptimal anti-CD3 stimulation per se is visible here. All clones are able support suboptimal TCR stimulation in OX40 positive preactived CD4 T cells when they are coated to plate. Cells do survive better and proliferate more. In the tumor microenvironment this could lead to increased anti-tumor activity of T cells.

FIGS. 10A, 10B, 10C, 10D, 10E and 10F show the bioactivity of the anti-human OX40 antibodies in preactivated human CD4 T cells in solution. No effect on cell proliferation, maturation or activation status of sub-optimally restimulated human CD4 T cells was detected in the absence of plate immobilization of anti-Ox40 binders (hu IgG1 P329GLALA format). PHA-L pre-activated CFSE-labeled human CD4 T cells were cultured for four days on plates pre-coated with mouse IgG Fcγ specific antibodies and mouse anti-human CD3 antibodies (clone OKT3, [3 ng/mL]). Titrated anti-Ox40 binders (hu IgG1 P329GLALA format) were added to the media and were present in solution throughout the experiment. Shown is the event count (FIG. 10A), the percentage of proliferating (CFSE-low) cells (FIG. 10B), the percentage of effector T cells (CD127low CD45RAlow) (FIG. 10C) and the percentage of CD62L low (FIG. 10E), OX40 positive (FIG. 10F) or Tim-3 positive cells (FIG. 10E) at day 4. Baseline values of samples containing only the plate-immobilized anti-human CD3 were substracted. Therefore, the enhancing effect of OX40 stimulation but not the effect of suboptimal anti-CD3 stimulation per se is visible here. There is no improved TCR stimulation in the absence of strong crosslinking (P329GLALA format in solution). Crosslinking is therefore essential for a bivalent aOx40 format to be agonistic on T cells. This crosslinking will be provided by FAP expressed on the cell surface of tumor or tumor-stromal cells in targeted formats.

FIGS. 13A, 13B, 13C, 13D, 13E, 13F, 13G, 13H and 13J, 13K, 13L and 13M show the SPR diagrams of simultaneous binding of bispecific bivalent 2+2 constructs (analyte 1) to immobilized human OX40 and human FAP (analyte 2). In FIGS. 13E, 13F, 13G and 13H, the simultaneous binding of bispecific monovalent 1+1 constructs (analyte 1) to immobilized human OX40 and human FAP (analyte 2) is shown. In FIGS. 13J, 13K and 13L the simultaneous binding of bispecific 2+1 constructs (analyte 1) to immobilized human OX40 and human FAP (analyte 2) is shown. FIG. 13M shows the binding to hu OX40 of the bispecific 2+1 constructs in a cell-based FRET assay (TagLite) (Example 5.4.2). The data show that the two anti-OX40 Fab domains in the 2+1 constucts bind to hu OX40 in comparable manner as a common IgG antibody.

FIGS. 14A, 14B, 14C, 14D, 14E, 14F, 14G and 14H show the binding of selected anti-OX40 binders (clone 8H9, 1G4) in a FAP targeted monovalent or bivalent format to resting and activated human PBMC, respectively. Binding characteristics to OX40 positive T cells (FIGS. 14B and 14D) were comparable for clones in a conventional bivalent hu IgG format (open square) and a FAP-targeted bivalent format (filled square). Binding of the same clone in a FAP-targeted monovalent format (filled triangle) was clearly weaker due to loss of avidity binding. In the absence of human Ox40 expressing cells no binding can be observed (resting cells, left graphs). Shown is the binding as median of fluorescence intensity (MFI) of FITC labeled anti-human IgG Fcγ-specific goat IgG F(ab')2 fragment which is used as secondary detection antibody. MFI was measured by flow cytometry and baseline corrected by subtracting the MFI of the blank control (see Example 4.3.2.1). DP88 huIgG1 P329G LALA is isotype antibody used as control. The x-axis shows the concentration of antibody constructs. In FIGS. 14A, 14B, 14C and 14D it can be seen that clone 1G4 binds to activated, OX40 expressing human CD4 T cells, and to a lower extent to activated human CD8 T cells. The bivalent construct binds stronger than the monovalent construct. The constructs do not bind to OX40 negative resting T cells. FIGS. 14E, 14F, 14G and 14H show that clone 8H9 binds to activated, OX40-expressing human CD4 T cells, and to a lower extent to activated human CD8 T cells. The bivalent construct binds stronger than the monovalent construct. The constructs do not bind to OX40 negative resting T cells.

FIGS. 15A, 15B, 15C, 15D, 15E and 15F show the binding of selected anti-OX40 binders (clone 8H9, 1G4) in a FAP targeted monovalent or bivalent format to FAP positive tumor cells. Transgenic modified mouse embryonic fibroblast NIH/3T3-huFAP clone 39 or WM266-4 cells express high levels of human fibroblast activation protein (huFAP). Only FAP-targeted mono- and bivalent anti-Ox40 constructs (filled square and triangle) but not the same clone in a human IgG1 P329GLALA format (open square) binds to NIH/3T3-huFAP clone 39 cells (FIG. 15A) and WM266-4 cells (FIG. 15B), respectively. Shown is the binding as median of fluorescence intensity (MFI) of Fluorescein isothiocyanate (FITC)-labeled anti-human IgG Fcγ-specific goat IgG F(ab')2 fragment which is used as secondary detection antibody. MFI was measured by flow cytometry. The x-axis shows the concentration of antibody constructs. The bivalent FAP construct binds stronger than the monovalent construct. Binding to human FAP-expressing tumor cells is also shown in FIGS. 15C, 15D, 15E and 15F (see Example 4.5.4.2 for more details).

FIGS. 16A, 16B, 16C, 16D, 16E, 16F, 16G, 16H and 16J, 16K, 16L, 16M and 16N show the NFκB activation by selected binders (8H9, 1G4) in a monovalent or bivalent FAP targeted format in the presence or absence of hyper-crosslinking. Shown is the activation of NF-κB signaling pathway in the reporter cells by selected binders 1G4 (FIG. 16A-16D) and 8H9 (FIG. 16E-16G) in a monovalent (filled triangle) or bivalent (filled square) FAP targeted format or as non-targeted hu IgG P329GLALA antibodies (open square). Hyper-crosslinking was provided by either anti-hu IgG Fcγ-specific secondary antibodies (ratio 1:2 of primary to secondary antibodies) or via FAP-expressing NIH/3T3-hu-FAP clone 39 and WM266-4 tumor cells (ratio 2:1 of FAP+ tumor cells to reporter cells). The NF-κB-mediated luciferase activity was characterized by blotting the units of released light (URL), measured during 0.5 s, versus the concentration in nM of tested compounds. URLs are emitted due to luciferase-mediated oxidation of luciferin to oxyluciferin. Values are baseline corrected by subtracting the URLs of the blank control. In FIG. 16A it can be seen that all constructs containing clone 1G4 were able to induce NFkB activation in Ox40+ HeLa reporter cells. Crosslinking by secondary anti IgG Fcγ specific antibody strongly increased NFκB activation. Addition of FAP positive cells (NIH or WM266-4) however increased only the agonistic potential of FAP targeted molecules, but not that of the P329GLALA IgG format. Bivalent constructs performed clearly better than monovalent constructs. In FIGS. 16E, 16F and 16G it is shown that all constructs containing clone 8H9 were able to induce NFκB activation in OX40+ HeLa reporter cells. Crosslinking by secondary anti IgG Fcγ specific antibody strongly increased NFκB activation. Addition of FAP positive cells (NIH) however increased only the agonistic potential of FAP targeted molecules, but not that of the P329GLALA IgG format. Bivalent constructs performed slightly better than monovalent constructs. In FIGS. 16H, 16J and 16K it can also be seen that constructs with monovalent binding to OX40 (1+1) are less efficient than constructs with bivalent binding to OX40 (2+1 and 2+2 constructs. Further data are given in FIGS. 16L, 16M and 16N and in Example 5.1.

FIGS. 21D, 21E, 21F, 21G, 21H and 21J, 21K, 21L, 21M, 21N and 21P show data as obtained in a second experiment. Monovalent anti-OX40 construct (1+1; filled triangle) was less able to rescue TCR stimulation than bivalent anti-OX40 targeting constructs (semi-filled circle, filled square). The bivalently to FAP binding 2+2 construct was already able at lower concentrations to rescue suboptimal TCR stimulation compared to the monovalently to FAP binding 2+1 constructs. In the 2+1 format the high affinity FAP binding clone 4B9 was clearly superior to the low affinity clone 28H1 (FIGS. 21J, 21K, 21L, 21M and 21N). This suggests that the $EC_{50}$ values of the observed bioactivity were driven by the binding to FAP (2+2>2+1 (4B9)>2+1 (28H1)). In FIG. 21P the agonistic capacity of each construct was quantified for the analyzed markers as area under the curve and plotted against each other. The observed bioactivity was best for the FAP (28H1) (2+2) construct, followed by the FAP (4B9) (2+1) construct and then the FAP (28H1) (2+1) construct.

FIGS. 25A, 25B, 25C and 25D show the binding of mouse IgGs to 4-1BB expressing mouse T cells. Shown is the binding to resting and activated mouse T cells of the anti-mouse 4-1BB binding clone 20G2 transferred to the formats mouse IgG1 DAPG and mouse IgG1 wildtype (wt). As negative control a commercial non-4-1BB binding mouse IgG1 wt isotype control was used (open grey circle, BioLegend, Cat.-No. 400153). In the upper panels binding to resting CD4+ T cells (FIG. 25A) and activated CD4+ T cells (FIG. 25B) is shown, whereas in the lower panels binding to resting CD8+ T cells (FIG. 25C) and activated CD8+ T cells (FIG. 25D) is shown. The binding is characterized by plotting the median of fluorescence of intensity (MFI) of FITC-labeled anti-mouse IgG Fcγ-specific goat IgG F(ab')2 fragment that is used as secondary detection antibody versus the concentration in nM of the tested primary anti-4-1BB-binding moIgG antibodies. MFI was measured by flow cytometry and baseline corrected by subtracting the MFI of the blank control (no primary antibody).

FIGS. 26A and 26B show the binding to 4-1BB expressing cynomolgus T cells. Shown is the binding to activated cynomolgus T cells of four anti-human 4-1BB binding huIgG1 P329G LALA antibody clones (filled diamond: clone 25G7, filled square: clone 12B3, filled star: clone 11D5, pointing-up triangle: clone 9B11). As negative control a non-4-1BB binding DP47 huIgG1 P329G LALA antibody was used (open grey circle). Shown is the binding to activated CD4+ T cells (FIG. 26A) and to activated CD8+ T cells (FIG. 26B) respectively. The binding is characterized by plotting the median of fluorescence of intensity (MFI) of FITC-labeled anti-human IgG Fcγ-specific goat IgG F(ab')2 fragment that is used as secondary detection antibody versus the concentration in nM of the tested primary anti-4-1BB-binding huIgG1 P329G LALA antibodies. MFI was measured by flow cytometry and baseline corrected by subtracting the MFI of the blank control (no primary antibody).

FIGS. 27A, 27B, 27C, 27D, 27E refer to ligand binding properties of the anti-4-1BB antibodies of the invention as determined by surface plasmon resonance. The interaction between human anti-4-1BB IgG 25G7, 11D5, 9B11 and 12B3 and the preformed complex hu4-1BB Ligand/hu4-1BB is shown as well as the interaction of mouse anti-4-1BB clone 20G2 and the preformed complex mu4-1BB Ligand/mu4-1BB.

FIGS. 28A, 28B, 28C, 28D, 28E and 28F relate to competition binding experiments. FIGS. 28A, 28B and 28C show the interaction between anti-4-1BB IgG clones 12B3, 11D5 and 25G7 and a preformed complex of clone 9B11 and hu4-1BB. FIGS. 28D, 28E and 28F show the interaction between anti-4-1BB IgG clones 12B3, 9B11 and 25G7 and a preformed complex of clone 11D5 and hu4-1BB. It can be concluded that anti-4-1BB clones 12B3, 11D5 and 9B11 share a different spatial epitope as 25G7, since the two antibodies can bind simultaneously to human 4-1BB.

FIGS. 31A, 31B, 31C and 31D show functional properties of different anti-human 4-1BB clones in vitro. Pre-activated human CD8+ T cells were activated with different concentrations of surface immobilized anti-human-4-1BB-specific huIgG1 P329G LALA antibodies in the absence of anti-human CD3 antibody (FIGS. 31A and 31C) or in the presence of sub-optimal concentration of surface immobilized anti-human CD3 antibody (FIGS. 31B and 31D). Shown is the frequency of IFNγ+ (A and B) and TNFα+ (C and D) CD8+ T cells in the total CD8+ T cell population versus the concentration of surface immobilized 4-1BB-binding huIgG1 P329G LALA in pM. In the presence of CD3-stimulation 4-1BB-co-stimulation could increase IFNγ (FIG. 31B) and TNFα (FIG. 31D) secretion in a concentration dependent manner. In the absence of CD3-stimulation, activation of 4-1BB had no effect on IFNγ (FIG. 31A) and TNFα (FIG. 31C) secretion.

FIGS. 35A, 35B, 35C and 35D show simultaneous binding of bispecific bivalent anti-4-1BB/anti-FAP constructs is shown in FIGS. 35A-35D. The bispecific constructs were used as analyte 1 to immobilized human 4-1BB and human FAP was used as analyte 2. All bispecific constructs could bind simultaneously human 4-1BB and human FAP.

FIG. 37A is a pictogram of the assay setup; FIGS. 37B and 37C show the detected simultaneous binding of the bispecific antigen binding molecules in 2+1 format (analyte 1) to immobilized human 4-1BB and human FAP.

FIGS. 38A, 38B, 38C, 38D, 38E and 38F show the binding to resting CD4$^+$ (upper panels) and CD8$^+$ T cells (lower panels) of the human-4-1BB-specific clone 11D5 (FIGS. 38A and 38C), 12B3 (FIGS. 38B and 38D) and 25G7 (FIGS. 38E and 38F). Binding is presented as geo mean of fluorescence of intensity of secondary detection antibody PE-conjugated anti-human IgG Fcγ-fragment-specific goat IgG F(ab2') fragment versus the concentration of primary 4-1BB-binding antibody. In all blots the negative control DP47-untargeted huIgG1 P329G LALA was used (open black circle, dotted line). None of the constructs showed specific binding to resting human CD4$^+$ T cells (FIGS. 38A, 38B and 38E) or resting CD8$^+$ T cells (FIGS. 38C, 38D and 38F).

FIGS. 39A, 39B, 39C, 39D, 39E and 39F show the binding to activated CD4$^+$ (upper panels) and CD8$^+$ T cells (lower panels) of the human-4-1BB-specific clone 11D5 (FIGS. 39A and 39C), 12B3 (FIGS. 39B and 39D) and 25G7 (FIGS. 39E and 39F). Binding is shown as geo mean of fluorescence of intensity of secondary detection antibody PE-conjugated anti-human IgG Fcγ-fragment-specific goat IgG F(ab2') fragment versus the concentration of primary 4-1BB-binding antibody. In all blots the negative control DP47-untargeted huIgG1 P329G LALA was used (open black circle, dotted line). All constructs bound mainly to activated human CD8$^+$ T cells (FIGS. 39C, 39D and 39F), which display a higher 4-1BB-expression than activated human CD4$^+$ T cells (FIGS. 39A, 39B and 39E).

FIG. 40 summarizes the binding to activated human CD8$^+$ T cells of different clones and formats as area under the curve (AUC) of binding curves. The different formats and used anti-FAP binding clones are indicated as pictograms below the graph, the 4-1BB-binding clones are indicated by column pattern: DP47 control molecule in white, 25G7 containing molecules in black, if DP47-untargeted in black with white stripes, clone 11D5 in grey and clone 12B3 in white/black-check.

FIGS. 41A, 41B, 41C, 41D, 41E and 41F show the binding to human FAP-expressing melanoma cell line WM-266-4 (FIGS. 41A, 41B and 41E) and NIH/3T3-huFAP cone 19 cells (FIGS. 41C, 41D and 41F). Binding is shown as geo mean of fluorescence of intensity of secondary detection antibody PE-conjugated anti-human IgG Fcγ-fragment-specific goat IgG F(ab2') fragment versus the concentration of primary 4-1BB-binding antibody. Binding curves using constructs containing 4-1BB-binding clone 11D5 are shown in FIGS. 41A and 41C, with clone 12B3 in FIGS. 41B and 41D and with clone 25G7 in FIGS. 41E and 41F. In all blots the negative control DP47-untargeted huIgG1 P329G LALA was used (open black circle, dotted line). Only FAP-targeted formats bind to the FAP-expressing cells and not their parental anti-4-1BB huIgG1P329G LALA antibodies. Therefore independent of the format all shown FAP-targeted molecules feature a FAP-specific targeting property. Depending on the format, FAP-binding clone and targeting moiety, some molecules possess a better FAP-targeting property than others.

FIGS. 43A, 43B, 43C, 43D, 43E, 43F, 43G, 43H and 43I show NF-κB-mediated luciferase activity in the 4-1BB-expressing reporter cell line HeLa-hu4-1BB-NFkB-luc. Luciferase activity is shown on the y-axis as units of released light (URLs) versus the added concentration of agonistic human4-1BB-binding molecules after 6 hours of incubation. In FIGS. 43A, 43D and 43G no FAP-expressing tumor cells were added. In FIGS. 43B, 43E and 43H FAP-expressing human melanoma cell line WM-266-4 and in FIGS. 43C, 43F and 43I human FAP-transfected NIH/3T3 cells were added in a ratio 5:1 to the reporter cell line and incubated for 6 h. Activation curves using constructs containing 4-1BB-binding clone 11D5 are shown in FIGS. 43A, 43B and 43C, with clone 12B3 in FIGS. 43D, 43E and 43F and with clone 25G7 in FIGS. 43G, 43H and 43I. Only FAP-targeted formats induce a luciferase activity in the presence of FAP-expressing tumor cells. Activation levels depend on the clone, the format and the FAP-expressing tumor cell line.

DETAILED DESCRIPTION OF THE INVENTION

Definitions

Figure 1B:
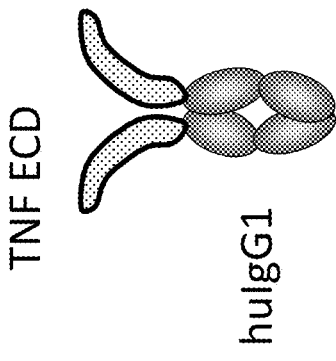
FIG. 1B shows a dimeric human TNF receptor antigen Fc fusion molecule with a C-terminal Ha tag that was used for the testing of the binding of TNF receptor antibodies in the presence of TNF ligand (ligand blocking property).

Unless defined otherwise, technical and scientific terms used herein have the same meaning as generally used in the art to which this invention belongs. For purposes of interpreting this specification, the following definitions will apply and whenever appropriate, terms used in the singular will also include the plural and vice versa.

As used herein, the term "antigen binding molecule" refers in its broadest sense to a molecule that specifically binds an antigenic determinant. Examples of antigen binding molecules are antibodies, antibody fragments and scaffold antigen binding proteins.

As used herein, the term "moiety capable of specific binding to a target cell antigen" refers to a polypeptide molecule that specifically binds to an antigenic determinant. In one aspect, the antigen binding moiety is able to activate signaling through its target cell antigen. In a particular aspect, the antigen binding moiety is able to direct the entity to which it is attached (e.g. the TNF family ligand trimer) to a target site, for example to a specific type of tumor cell or tumor stroma bearing the antigenic determinant. Moieties capable of specific binding to a target cell antigen include antibodies and fragments thereof as further defined herein. In addition, moieties capable of specific binding to a target cell antigen include scaffold antigen binding proteins as further defined herein, e.g. binding domains which are based on designed repeat proteins or designed repeat domains (see e.g. WO 2002/020565).

In relation to an antibody or fragment thereof, the term "moiety capable of specific binding to a target cell antigen" refers to the part of the molecule that comprises the area which specifically binds to and is complementary to part or all of an antigen. A moiety capable of specific antigen binding may be provided, for example, by one or more antibody variable domains (also called antibody variable regions). Particularly, a moiety capable of specific antigen binding comprises an antibody light chain variable region (VL) and an antibody heavy chain variable region (VH). In a particular aspect, the "moiety capable of specific binding to a target cell antigen" is a Fab fragment or a cross-Fab fragment.

The term "moiety capable of specific binding to a costimulatory TNF receptor family member" refers to a polypeptide molecule that specifically binds to a costimulatory TNF receptor family member. In one aspect, the antigen binding moiety is able to activate signaling through a costimulatory TNF receptor family member. Moieties capable of specific binding to a target cell antigen include antibodies and fragments thereof as further defined herein. In addition, moieties capable of specific binding to a costimulatory TNF receptor family member include scaffold antigen binding proteins as further defined herein, e.g. binding domains which are based on designed repeat proteins or designed repeat domains (see e.g. WO 2002/020565). Particularly, a moiety capable of specific binding to a costimulatory TNF receptor family member comprises an antibody light chain variable region (VL) and an antibody heavy chain variable region (VH). In a particular aspect, the "moiety capable of specific binding to a costimulatory TNF receptor family member" is a Fab fragment or a cross-Fab fragment.

The term "antibody" herein is used in the broadest sense and encompasses various antibody structures, including but not limited to monoclonal antibodies, polyclonal antibodies, monospecific and multispecific antibodies (e.g., bispecific antibodies), and antibody fragments so long as they exhibit the desired antigen-binding activity.

The term "monoclonal antibody" as used herein refers to an antibody obtained from a population of substantially homogeneous antibodies, i.e., the individual antibodies comprising the population are identical and/or bind the same epitope, except for possible variant antibodies, e.g. containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen.

The term "monospecific" antibody as used herein denotes an antibody that has one or more binding sites each of which bind to the same epitope of the same antigen. The term "bispecific" means that the antigen binding molecule is able to specifically bind to at least two distinct antigenic determinants. Typically, a bispecific antigen binding molecule comprises two antigen binding sites, each of which is specific for a different antigenic determinant. In certain embodiments the bispecific antigen binding molecule is capable of simultaneously binding two antigenic determinants, particularly two antigenic determinants expressed on two distinct cells.

The term "valent" as used within the current application denotes the presence of a specified number of binding sites specific for one distinct antigenic determinant in an antigen binding molecule that are specific for one distinct antigenic determinant. As such, the terms "bivalent", "tetravalent", and "hexavalent" denote the presence of two binding sites, four binding sites, and six binding sites specific for a certain antigenic determinant, respectively, in an antigen binding molecule. In particular aspects of the invention, the bispecific antigen binding molecules according to the invention can be monovalent for a certain antigenic determinant, meaning that they have only one binding site for said antigenic determinant or they can be bivalent for a certain antigenic determinant, meaning that they have two binding sites for said antigenic determinant.

The terms "full length antibody", "intact antibody", and "whole antibody" are used herein interchangeably to refer to an antibody having a structure substantially similar to a native antibody structure. "Native antibodies" refer to naturally occurring immunoglobulin molecules with varying structures. For example, native IgG-class antibodies are heterotetrameric glycoproteins of about 150,000 daltons, composed of two light chains and two heavy chains that are disulfide-bonded. From N- to C-terminus, each heavy chain has a variable region (VH), also called a variable heavy domain or a heavy chain variable domain, followed by three constant domains (CH1, CH2, and CH3), also called a heavy chain constant region. Similarly, from N- to C-terminus, each light chain has a variable region (VL), also called a variable light domain or a light chain variable domain, followed by a light chain constant domain (CL), also called a light chain constant region. The heavy chain of an antibody may be assigned to one of five types, called α (IgA), δ (IgD), ε (IgE), γ (IgG), or μ (IgM), some of which may be further divided into subtypes, e.g. γ1 (IgG1), γ2 (IgG2), γ3 (IgG3), γ4 (IgG4), α1 (IgA1) and α2 (IgA2). The light chain of an antibody may be assigned to one of two types, called kappa (κ) and lambda (λ), based on the amino acid sequence of its constant domain.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')$_2$; diabodies, triabodies, tetrabodies, cross-Fab fragments; linear antibodies; single-chain antibody molecules (e.g. scFv); and single domain antibodies. For a review of certain antibody fragments, see Hudson et al., Nat Med 9, 129-134 (2003). For a review of scFv fragments, see e.g. Plückthun, in The Pharmacology of Monoclonal Antibodies, vol. 113, Rosenburg and Moore eds., Springer-Verlag, New York, pp. 269-315 (1994); see also WO 93/16185; and U.S. Pat. Nos. 5,571,894 and 5,587,458. For discussion of Fab and F(ab')2 fragments comprising salvage receptor binding epitope residues and having increased in vivo half-life, see U.S. Pat. No. 5,869, 046. Diabodies are antibody fragments with two antigen-binding sites that may be bivalent or bispecific, see, for example, EP 404,097; WO 1993/01161; Hudson et al., Nat Med 9, 129-134 (2003); and Hollinger et al., Proc Natl Acad Sci USA 90, 6444-6448 (1993). Triabodies and tetrabodies are also described in Hudson et al., Nat Med 9, 129-134 (2003). Single-domain antibodies are antibody fragments comprising all or a portion of the heavy chain variable domain or all or a portion of the light chain variable domain of an antibody. In certain embodiments, a single-domain antibody is a human single-domain antibody (Domantis, Inc., Waltham, Mass.; see e.g. U.S. Pat. No. 6,248,516 B1). Antibody fragments can be made by various techniques, including but not limited to proteolytic digestion of an intact antibody as well as production by recombinant host cells (e.g. E. coli or phage), as described herein.

Papain digestion of intact antibodies produces two identical antigen-binding fragments, called "Fab" fragments containing each the heavy- and light-chain variable domains and also the constant domain of the light chain and the first constant domain (CH1) of the heavy chain. As used herein, Thus, the term "Fab fragment" refers to an antibody fragment comprising a light chain fragment comprising a VL domain and a constant domain of a light chain (CL), and a VH domain and a first constant domain (CH1) of a heavy chain. Fab' fragments differ from Fab fragments by the addition of a few residues at the carboxy terminus of the heavy chain CH1 domain including one or more cysteins from the antibody hinge region. Fab'-SH are Fab' fragments wherein the cysteine residue(s) of the constant domains bear a free thiol group. Pepsin treatment yields an F(ab')$_2$ fragment that has two antigen-combining sites (two Fab fragments) and a part of the Fc region. According to the present invention, the term "Fab fragment" also includes "cross-Fab fragments" or "crossover Fab fragments" as defined below.

The term "cross-Fab fragment" or "xFab fragment" or "crossover Fab fragment" refers to a Fab fragment, wherein either the variable regions or the constant regions of the heavy and light chain are exchanged. Two different chain compositions of a cross-Fab molecule are possible and comprised in the bispecific antibodies of the invention: On the one hand, the variable regions of the Fab heavy and light chain are exchanged, i.e. the crossover Fab molecule comprises a peptide chain composed of the light chain variable region (VL) and the heavy chain constant region (CH1), and a peptide chain composed of the heavy chain variable region (VH) and the light chain constant region (CL). This crossover Fab molecule is also referred to as CrossFab$_{(VLVH)}$. On the other hand, when the constant regions of the Fab heavy and light chain are exchanged, the crossover Fab molecule comprises a peptide chain composed of the heavy chain variable region (VH) and the light chain constant region (CL), and a peptide chain composed of the light chain variable region (VL) and the heavy chain constant region (CH1). This crossover Fab molecule is also referred to as CrossFab$_{(CLCH1)}$.

A "single chain Fab fragment" or "scFab" is a polypeptide consisting of an antibody heavy chain variable domain (VH), an antibody constant domain 1 (CH1), an antibody light chain variable domain (VL), an antibody light chain constant domain (CL) and a linker, wherein said antibody domains and said linker have one of the following orders in N-terminal to C-terminal direction: a) VH-CH1-linker-VL-CL, b) VL-CL-linker-VH-CH1, c) VH-CL-linker-VL-CH1 or d) VL-CH1-linker-VH-CL; and wherein said linker is a polypeptide of at least 30 amino acids, preferably between 32 and 50 amino acids. Said single chain Fab fragments are stabilized via the natural disulfide bond between the CL domain and the CH1 domain. In addition, these single chain Fab molecules might be further stabilized by generation of interchain disulfide bonds via insertion of cysteine residues (e.g. position 44 in the variable heavy chain and position 100 in the variable light chain according to Kabat numbering).

A "crossover single chain Fab fragment" or "x-scFab" is a is a polypeptide consisting of an antibody heavy chain variable domain (VH), an antibody constant domain 1 (CH1), an antibody light chain variable domain (VL), an antibody light chain constant domain (CL) and a linker, wherein said antibody domains and said linker have one of the following orders in N-terminal to C-terminal direction: a) VH-CL-linker-VL-CH1 and b) VL-CH1-linker-VH-CL; wherein VH and VL form together an antigen-binding site which binds specifically to an antigen and wherein said linker is a polypeptide of at least 30 amino acids. In addition, these x-scFab molecules might be further stabilized by generation of interchain disulfide bonds via insertion of cysteine residues (e.g. position 44 in the variable heavy chain and position 100 in the variable light chain according to Kabat numbering).

A "single-chain variable fragment (scFv)" is a fusion protein of the variable regions of the heavy ($V_H$) and light chains ($V_L$) of an antibody, connected with a short linker peptide of ten to about 25 amino acids. The linker is usually rich in glycine for flexibility, as well as serine or threonine for solubility, and can either connect the N-terminus of the $V_H$ with the C-terminus of the $V_L$, or vice versa. This protein retains the specificity of the original antibody, despite removal of the constant regions and the introduction of the linker. scFv antibodies are, e.g. described in Houston, J. S., Methods in Enzymol. 203 (1991) 46-96). In addition, antibody fragments comprise single chain polypeptides having the characteristics of a VH domain, namely being able to assemble together with a VL domain, or of a VL domain, namely being able to assemble together with a VH domain to a functional antigen binding site and thereby providing the antigen binding property of full length antibodies.

"Scaffold antigen binding proteins" are known in the art, for example, fibronectin and designed ankyrin repeat proteins (DARPins) have been used as alternative scaffolds for antigen-binding domains, see, e.g., Gebauer and Skerra, Engineered protein scaffolds as next-generation antibody therapeutics. Curr Opin Chem Biol 13:245-255 (2009) and Stumpp et al., Darpins: A new generation of protein therapeutics. Drug Discovery Today 13: 695-701 (2008). In one aspect of the invention, a scaffold antigen binding protein is selected from the group consisting of CTLA-4 (Evibody), Lipocalins (Anticalin), a Protein A-derived molecule such as Z-domain of Protein A (Affibody), an A-domain (Avimer/Maxibody), a serum transferrin (trans-body); a designed ankyrin repeat protein (DARPin), a variable domain of antibody light chain or heavy chain (single-domain antibody, sdAb), a variable domain of antibody heavy chain (nanobody, aVH), $V_{NAR}$ fragments, a fibronectin (AdNectin), a C-type lectin domain (Tetranectin); a variable domain of a new antigen receptor beta-lactamase ($V_{NAR}$ fragments), a human gamma-crystallin or ubiquitin (Affilin molecules); a kunitz type domain of human protease inhibitors, microbodies such as the proteins from the knottin family, peptide aptamers and fibronectin (adnectin). CTLA-4 (Cytotoxic T Lymphocyte-associated Antigen 4) is a CD28-family receptor expressed on mainly CD4$^+$ T-cells. Its extracellular domain has a variable domain-like Ig fold. Loops corresponding to CDRs of antibodies can be substituted with heterologous sequence to confer different binding properties. CTLA-4 molecules engineered to have different binding specificities are also known as Evibodies (e.g. U.S. Pat. No. 7,166,697B1). Evibodies are around the same size as the isolated variable region of an antibody (e.g. a domain antibody). For further details see Journal of Immunological Methods 248 (1-2), 31-45 (2001). Lipocalins are a family of extracellular proteins which transport small hydrophobic molecules such as steroids, bilins, retinoids and lipids. They have a rigid beta-sheet secondary structure with a number of loops at the open end of the conical structure which can be engineered to bind to different target antigens. Anticalins are between 160-180 amino acids in size, and are derived from lipocalins. For further details see Biochim Biophys Acta 1482: 337-350 (2000), U.S. Pat. No. 7,250,297B1 and US20070224633. An affibody is a scaffold derived from Protein A of Staphylococcus aureus which can be engineered to bind to antigen. The domain consists of a three-helical bundle of approximately 58 amino acids. Libraries have been generated by randomization of surface residues. For further details see Protein Eng. Des. Sel. 2004, 17, 455-462 and EP 1641818A1. Avimers are multidomain proteins derived from the A-domain scaffold family. The native domains of approximately 35 amino acids adopt a defined disulfide bonded structure. Diversity is generated by shuffling of the natural variation exhibited by the family of A-domains. For further details see Nature Biotechnology 23(12), 1556-1561 (2005) and Expert Opinion on Investigational Drugs 16(6), 909-917 (June 2007). A transferrin is a monomeric serum transport glycoprotein. Transferrins can be engineered to bind different target antigens by insertion of peptide sequences in a permissive surface loop. Examples of engineered transferrin scaffolds include the Trans-body. For further details see J. Biol. Chem 274, 24066-24073 (1999). Designed Ankyrin Repeat Proteins (DARPins) are derived from Ankyrin which is a family of proteins that mediate attachment of integral membrane proteins to the cytoskeleton. A single ankyrin repeat is a 33 residue motif consisting of two alpha-helices and a beta-turn. They can be engineered to bind different target antigens by randomizing residues in the first alpha-helix and a beta-turn of each repeat. Their binding interface can be increased by increasing the number of modules (a method of affinity maturation). For further details see J. Mol. Biol. 332, 489-503 (2003), PNAS 100(4), 1700-1705 (2003) and J. Mol. Biol. 369, 1015-1028 (2007) and US20040132028A1. A single-domain antibody is an antibody fragment consisting of a single monomeric variable antibody domain. The first single domains were derived from the variable domain of the antibody heavy chain from camelids (nanobodies or $V_HH$ fragments). Furthermore, the term single-domain antibody includes an autonomous human heavy chain variable domain (aVH) or $V_{NAR}$ fragments derived from sharks. Fibronectin is a scaffold which can be engineered to bind to antigen. Adnectins consists of a backbone of the natural amino acid sequence of the 10th domain of the 15 repeating units of human fibronectin type III (FN3). Three loops at one end of the .beta.-sandwich can be engineered to enable an Adnectin to specifically recognize a therapeutic target of interest. For further details see Protein Eng. Des. Sel. 18, 435-444 (2005), US20080139791, WO2005056764 and U.S. Pat. No. 6,818,418B1. Peptide aptamers are combinatorial recognition molecules that consist of a constant scaffold protein, typically thioredoxin (TrxA) which contains a constrained variable peptide loop inserted at the active site. For further details see Expert Opin. Biol. Ther. 5, 783-797 (2005). Microbodies are derived from naturally occurring microproteins of 25-50 amino acids in length which contain 3-4 cysteine bridges—examples of microproteins include KalataBI and conotoxin and knottins. The microproteins have a loop which can be engineered to include upto 25 amino acids without affecting the overall fold of the microprotein. For further details of engineered knottin domains, see WO2008098796.

An "antigen binding molecule that binds to the same epitope" as a reference molecule refers to an antigen binding molecule that blocks binding of the reference molecule to its antigen in a competition assay by 50% or more, and conversely, the reference molecule blocks binding of the antigen binding molecule to its antigen in a competition assay by 50% or more.

The term "antigen binding domain" or "antigen-binding site" refers to the part of an antigen binding molecule that comprises the area which specifically binds to and is complementary to part or all of an antigen. Where an antigen is large, an antigen binding molecule may only bind to a particular part of the antigen, which part is termed an epitope. An antigen binding domain may be provided by, for example, one or more variable domains (also called variable regions). Preferably, an antigen binding domain comprises an antibody light chain variable region (VL) and an antibody heavy chain variable region (VH).

As used herein, the term "antigenic determinant" is synonymous with "antigen" and "epitope," and refers to a site (e.g. a contiguous stretch of amino acids or a conformational configuration made up of different regions of non-contiguous amino acids) on a polypeptide macromolecule to which an antigen binding moiety binds, forming an antigen binding moiety-antigen complex. Useful antigenic determinants can be found, for example, on the surfaces of tumor cells, on the surfaces of virus-infected cells, on the surfaces of other diseased cells, on the surface of immune cells, free in blood serum, and/or in the extracellular matrix (ECM). The proteins useful as antigens herein can be any native form the proteins from any vertebrate source, including mammals such as primates (e.g. humans) and rodents (e.g. mice and rats), unless otherwise indicated. In a particular embodiment the antigen is a human protein. Where reference is made to a specific protein herein, the term encompasses the "full-length", unprocessed protein as well as any form of the protein that results from processing in the cell. The term also encompasses naturally occurring variants of the protein, e.g. splice variants or allelic variants.

By "specific binding" is meant that the binding is selective for the antigen and can be discriminated from unwanted or non-specific interactions. The ability of an antigen binding molecule to bind to a specific antigen can be measured either through an enzyme-linked immunosorbent assay (ELISA) or other techniques familiar to one of skill in the art, e.g. Surface Plasmon Resonance (SPR) technique (analyzed on a BIAcore instrument) (Liljeblad et al., Glyco J 17, 323-329 (2000)), and traditional binding assays (Heeley, Endocr Res 28, 217-229 (2002)). In one embodiment, the extent of binding of an antigen binding molecule to an unrelated protein is less than about 10% of the binding of the antigen binding molecule to the antigen as measured, e.g. by SPR. In certain embodiments, an molecule that binds to the antigen has a dissociation constant (Kd) of ≤1 μM, ≤100 nM, ≤10 nM, ≤1 nM, ≤0.1 nM, ≤0.01 nM, or ≤0.001 nM (e.g. $10^{-8}$ M or less, e.g. from $10^{-8}$M to $10^{-13}$ M, e.g. from $10^{-9}$ M to $10^{-13}$ M).

"Affinity" or "binding affinity" refers to the strength of the sum total of non-covalent interactions between a single binding site of a molecule (e.g. an antibody) and its binding partner (e.g. an antigen). Unless indicated otherwise, as used herein, "binding affinity" refers to intrinsic binding affinity which reflects a 1:1 interaction between members of a binding pair (e.g. antibody and antigen). The affinity of a molecule X for its partner Y can generally be represented by the dissociation constant (Kd), which is the ratio of dissociation and association rate constants (koff and kon, respectively). Thus, equivalent affinities may comprise different rate constants, as long as the ratio of the rate constants remains the same. Affinity can be measured by common methods known in the art, including those described herein. A particular method for measuring affinity is Surface Plasmon Resonance (SPR).

An "affinity matured" antibody refers to an antibody with one or more alterations in one or more hypervariable regions (HVRs), compared to a parent antibody which does not possess such alterations, such alterations resulting in an improvement in the affinity of the antibody for antigen.

A "target cell antigen" as used herein refers to an antigenic determinant presented on the surface of a target cell, for example a cell in a tumor such as a cancer cell or a cell of the tumor stroma. In certain embodiments, the target cell antigen is an antigen on the surface of a tumor cell. In one embodiment, target cell antigen is selected from the group consisting of Fibroblast Activation Protein (FAP), Carcinoembryonic Antigen (CEA), Melanoma-associated Chondroitin Sulfate Proteoglycan (MCSP), Epidermal Growth Factor Receptor (EGFR), CD19, CD20 and CD33. In particular, the target cell antigen is Fibroblast Activation Protein (FAP).

The term "Fibroblast activation protein (FAP)", also known as Prolyl endopeptidase FAP or Seprase (EC 3.4.21), refers to any native FAP from any vertebrate source, including mammals such as primates (e.g. humans) non-human primates (e.g. cynomolgus monkeys) and rodents (e.g. mice and rats), unless otherwise indicated. The term encompasses "full-length," unprocessed FAP as well as any form of FAP that results from processing in the cell. The term also encompasses naturally occurring variants of FAP, e.g., splice variants or allelic variants. In one embodiment, the antigen binding molecule of the invention is capable of specific binding to human, mouse and/or cynomolgus FAP. The amino acid sequence of human FAP is shown in UniProt (www.uniprot.org) accession no. Q12884 (version 149, SEQ ID NO:84), or NCBI (www.ncbi.nlm.nih.gov/) RefSeq NP_004451.2. The extracellular domain (ECD) of human FAP extends from amino acid position 26 to 760. The amino acid and nucleotide sequences of a His-tagged human FAP ECD is shown in SEQ ID NOs 85 and 86, respectively. The amino acid sequence of mouse FAP is shown in UniProt accession no. P97321 (version 126, SEQ ID NO:87), or NCBI RefSeq NP_032012.1. The extracellular domain (ECD) of mouse FAP extends from amino acid position 26 to 761. SEQ ID NOs 88 and 89 show the amino acid and nucleotide sequences, respectively, of a His-tagged mouse FAP ECD. SEQ ID NOs 90 and 91 show the amino acid and nucleotide sequences, respectively, of a His-tagged cynomolgus FAP ECD. Preferably, an anti-FAP binding molecule of the invention binds to the extracellular domain of FAP.

The term "Carcinoembroynic antigen (CEA)", also known as Carcinoembryonic antigen-related cell adhesion molecule 5 (CEACAM5), refers to any native CEA from any vertebrate source, including mammals such as primates (e.g. humans) non-human primates (e.g. cynomolgus monkeys) and rodents (e.g. mice and rats), unless otherwise indicated. The amino acid sequence of human CEA is shown in UniProt accession no. P06731 (version 151, SEQ ID NO:92). The term "Melanoma-associated Chondroitin Sulfate Proteoglycan (MCSP)", also known as Chondroitin Sulfate Proteoglycan 4 (CSPG4) refers to any native MCSP from any vertebrate source, including mammals such as primates (e.g. humans) non-human primates (e.g. cynomolgus monkeys) and rodents (e.g. mice and rats), unless otherwise indicated. The amino acid sequence of human MCSP is shown in UniProt accession no. Q6UVK1 (version 103, SEQ ID NO:93). The term "Epidermal Growth Factor Receptor (EGFR)", also named Proto-oncogene c-ErbB-1 or Receptor tyrosine-protein kinase erbB-1, refers to any native EGFR from any vertebrate source, including mammals such as primates (e.g. humans) non-human primates (e.g. cynomolgus monkeys) and rodents (e.g. mice and rats), unless otherwise indicated. The amino acid sequence of human EGFR is shown in UniProt accession no. P00533 (version 211, SEQ ID NO:94). The term "CD19" refers to B-lymphocyte antigen CD19, also known as B-lymphocyte surface antigen B4 or T-cell surface antigen Leu-12 and includes any native CD19 from any vertebrate source, including mammals such as primates (e.g. humans) non-human primates (e.g. cynomolgus monkeys) and rodents (e.g. mice and rats), unless otherwise indicated. The amino acid sequence of human CD19 is shown in Uniprot accession no. P15391 (version 160, SEQ ID NO:95). "CD20" refers to B-lymphocyte antigen CD20, also known as membrane-spanning 4-domains subfamily A member 1 (MS4A1), B-lymphocyte surface antigen B1 or Leukocyte surface antigen Leu-16, and includes any native CD20 from any vertebrate source, including mammals such as primates (e.g. humans) non-human primates (e.g. cynomolgus monkeys) and rodents (e.g. mice and rats), unless otherwise indicated. The amino acid sequence of human CD20 is shown in Uniprot accession no. P11836 (version 149, SEQ ID NO:96). "CD33" refers to Myeloid cell surface antigen CD33, also known as SIGLEC3 or gp67, and includes any native CD33 from any vertebrate source, including mammals such as primates (e.g. humans) non-human primates (e.g. cynomolgus monkeys) and rodents (e.g. mice and rats), unless otherwise indicated. The amino acid sequence of human CD33 is shown in Uniprot accession no. P20138 (version 157, SEQ ID NO:97).

The term "variable region" or "variable domain" refers to the domain of an antibody heavy or light chain that is involved in binding the antigen binding molecule to antigen. The variable domains of the heavy chain and light chain (VH and VL, respectively) of a native antibody generally have similar structures, with each domain comprising four conserved framework regions (FRs) and three hypervariable regions (HVRs). See, e.g., Kindt et al., Kuby Immunology, 6th ed., W.H. Freeman and Co., page 91 (2007). A single VH or VL domain may be sufficient to confer antigen-binding specificity.

The term "hypervariable region" or "HVR," as used herein refers to each of the regions of an antibody variable domain which are hypervariable in sequence and/or form structurally defined loops ("hypervariable loops"). Generally, native four-chain antibodies comprise six HVRs; three in the VH (H1, H2, H3), and three in the VL (L1, L2, L3). HVRs generally comprise amino acid residues from the hypervariable loops and/or from the "complementarity determining regions" (CDRs), the latter being of highest sequence variability and/or involved in antigen recognition. Exemplary hypervariable loops occur at amino acid residues 26-32 (L1), 50-52 (L2), 91-96 (L3), 26-32 (H1), 53-55 (H2), and 96-101 (H3). (Chothia and Lesk, *J. Mol. Biol.* 196:901-917 (1987).) Exemplary CDRs (CDR-L1, CDR-L2, CDR-L3, CDR-H1, CDR-H2, and CDR-H3) occur at amino acid residues 24-34 of L1, 50-56 of L2, 89-97 of L3, 31-35B of H1, 50-65 of H2, and 95-102 of H3. (Kabat et al., *Sequences of Proteins of Immunological Interest*, 5th Ed. Public Health Service, National Institutes of Health, Bethesda, Md. (1991).) Hypervariable regions (HVRs) are also referred to as complementarity determining regions (CDRs), and these terms are used herein interchangeably in reference to portions of the variable region that form the antigen binding regions. This particular region has been described by Kabat et al., U.S. Dept. of Health and Human Services, "Sequences of Proteins of Immunological Interest" (1983) and by Chothia et al., *J. Mol. Biol.* 196:901-917 (1987), where the definitions include overlapping or subsets of amino acid residues when compared against each other. Nevertheless, application of either definition to refer to a CDR of an antibody or variants thereof is intended to be within the scope of the term as defined and used herein. The appropriate amino acid residues which encompass the CDRs as defined by each of the above cited references are set forth below in Table A as a comparison. The exact residue numbers which encompass a particular CDR will vary depending on the sequence and size of the CDR. Those skilled in the art can routinely determine which residues comprise a particular CDR given the variable region amino acid sequence of the antibody.

TABLE A

CDR Definitions[1]

| CDR | Kabat | Chothia | AbM[2] |
|---|---|---|---|
| $V_H$ CDR1 | 31-35 | 26-32 | 26-35 |
| $V_H$ CDR2 | 50-65 | 52-58 | 50-58 |
| $V_H$ CDR3 | 95-102 | 95-102 | 95-102 |
| $V_L$ CDR1 | 24-34 | 26-32 | 24-34 |
| $V_L$ CDR2 | 50-56 | 50-52 | 50-56 |
| $V_L$ CDR3 | 89-97 | 91-96 | 89-97 |

[1]Numbering of all CDR definitions in Table A is according to the numbering conventions set forth by Kabat et al. (see below).
[2]"AbM" with a lowercase "b" as used in Table A refers to the CDRs as defined by Oxford Molecular's "AbM" antibody modeling software.

Kabat et al. also defined a numbering system for variable region sequences that is applicable to any antibody. One of ordinary skill in the art can unambiguously assign this system of "Kabat numbering" to any variable region sequence, without reliance on any experimental data beyond the sequence itself. As used herein, "Kabat numbering" refers to the numbering system set forth by Kabat et al., U.S. Dept. of Health and Human Services, "Sequence of Proteins of Immunological Interest" (1983). Unless otherwise specified, references to the numbering of specific amino acid residue positions in an antibody variable region are according to the Kabat numbering system.

With the exception of CDR1 in VH, CDRs generally comprise the amino acid residues that form the hypervariable loops. CDRs also comprise "specificity determining residues," or "SDRs," which are residues that contact antigen. SDRs are contained within regions of the CDRs called abbreviated-CDRs, or a-CDRs. Exemplary a-CDRs (a-CDR-L1, a-CDR-L2, a-CDR-L3, a-CDR-H1, a-CDR-H2, and a-CDR-H3) occur at amino acid residues 31-34 of L1, 50-55 of L2, 89-96 of L3, 31-35B of H1, 50-58 of H2, and 95-102 of H3. (See Almagro and Fransson, *Front. Biosci.* 13:1619-1633 (2008).) Unless otherwise indicated, HVR residues and other residues in the variable domain (e.g., FR residues) are numbered herein according to Kabat et al., supra.

"Framework" or "FR" refers to variable domain residues other than hypervariable region (HVR) residues. The FR of a variable domain generally consists of four FR domains: FR1, FR2, FR3, and FR4. Accordingly, the HVR and FR sequences generally appear in the following sequence in VH (or VL): FR1-H1(L1)-FR2-H2(L2)-FR3-H3(L3)-FR4.

The term "chimeric" antibody refers to an antibody in which a portion of the heavy and/or light chain is derived from a particular source or species, while the remainder of the heavy and/or light chain is derived from a different source or species.

The "class" of an antibody refers to the type of constant domain or constant region possessed by its heavy chain. There are five major classes of antibodies: IgA, IgD, IgE, IgG, and IgM, and several of these may be further divided into subclasses (isotypes), e.g. $IgG_1$, $IgG_2$, $IgG_3$, $IgG_4$, $IgA_1$, and $IgA_2$. The heavy chain constant domains that correspond to the different classes of immunoglobulins are called $\alpha$, $\delta$, $\epsilon$, $\gamma$, and $\mu$ respectively.

A "humanized" antibody refers to a chimeric antibody comprising amino acid residues from non-human HVRs and amino acid residues from human FRs. In certain embodiments, a humanized antibody will comprise substantially all of at least one, and typically two, variable domains, in which all or substantially all of the HVRs (e.g., CDRs) correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization. Other forms of "humanized antibodies" encompassed by the present invention are those in which the constant region has been additionally modified or changed from that of the original antibody to generate the properties according to the invention, especially in regard to C1q binding and/or Fc receptor (FcR) binding.

A "human" antibody is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

The term "Fc domain" or "Fc region" herein is used to define a C-terminal region of an antibody heavy chain that contains at least a portion of the constant region. The term includes native sequence Fc regions and variant Fc regions. An IgG Fc region comprises an IgG CH2 and an IgG CH3 domain. The "CH2 domain" of a human IgG Fc region usually extends from an amino acid residue at about position 231 to an amino acid residue at about position 340. In one embodiment, a carbohydrate chain is attached to the CH2 domain. The CH2 domain herein may be a native sequence CH2 domain or variant CH2 domain. The "CH3 domain" comprises the stretch of residues C-terminal to a CH2 domain in an Fc region (i.e. from an amino acid residue at about position 341 to an amino acid residue at about position 447 of an IgG). The CH3 region herein may be a native sequence CH3 domain or a variant CH3 domain (e.g. a CH3 domain with an introduced "protuberance" ("knob") in one chain thereof and a corresponding introduced "cavity" ("hole") in the other chain thereof; see U.S. Pat. No. 5,821,333, expressly incorporated herein by reference). Such variant CH3 domains may be used to promote heterodimerization of two non-identical antibody heavy chains as herein described. In one embodiment, a human IgG heavy chain Fc region extends from Cys226, or from Pro230, to the carboxyl-terminus of the heavy chain. However, the C-terminal lysine (Lys447) of the Fc region may or may not be present. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, Md., 1991.

The "knob-into-hole" technology is described e.g. in U.S. Pat. Nos. 5,731,168; 7,695,936; Ridgway et al., Prot Eng 9, 617-621 (1996) and Carter, J Immunol Meth 248, 7-15 (2001). Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g. tyrosine or tryptophan). Compensatory cavities of identical or similar size to the protuberances are created in the interface of the second polypeptide by replacing large amino acid side chains with smaller ones (e.g. alanine or threonine). The protuberance and cavity can be made by altering the nucleic acid encoding the polypeptides, e.g. by site-specific mutagenesis, or by peptide synthesis. In a specific embodiment a knob modification comprises the amino acid substitution T366W in one of the two subunits of the Fc domain, and the hole modification comprises the amino acid substitutions T366S, L368A and Y407V in the other one of the two subunits of the Fc domain. In a further specific embodiment, the subunit of the Fc domain comprising the knob modification additionally comprises the amino acid substitution S354C, and the subunit of the Fc domain comprising the hole modification additionally comprises the amino acid substitution Y349C. Introduction of these two cysteine residues results in the formation of a disulfide bridge between the two subunits of the Fc region, thus further stabilizing the dimer (Carter, J Immunol Methods 248, 7-15 (2001)).

A "region equivalent to the Fc region of an immunoglobulin" is intended to include naturally occurring allelic variants of the Fc region of an immunoglobulin as well as variants having alterations which produce substitutions, additions, or deletions but which do not decrease substantially the ability of the immunoglobulin to mediate effector functions (such as antibody-dependent cellular cytotoxicity). For example, one or more amino acids can be deleted from the N-terminus or C-terminus of the Fc region of an immunoglobulin without substantial loss of biological function. Such variants can be selected according to general rules known in the art so as to have minimal effect on activity (see, e.g., Bowie, J. U. et al., Science 247:1306-10 (1990)).

The term "effector functions" refers to those biological activities attributable to the Fc region of an antibody, which vary with the antibody isotype. Examples of antibody effector functions include: C1q binding and complement dependent cytotoxicity (CDC), Fc receptor binding, antibody-dependent cell-mediated cytotoxicity (ADCC), antibody-dependent cellular phagocytosis (ADCP), cytokine secretion, immune complex-mediated antigen uptake by antigen presenting cells, down regulation of cell surface receptors (e.g. B cell receptor), and B cell activation.

Fc receptor binding dependent effector functions can be mediated by the interaction of the Fc-region of an antibody with Fc receptors (FcRs), which are specialized cell surface receptors on hematopoietic cells. Fc receptors belong to the immunoglobulin superfamily, and have been shown to mediate both the removal of antibody-coated pathogens by phagocytosis of immune complexes, and the lysis of erythrocytes and various other cellular targets (e.g. tumor cells) coated with the corresponding antibody, via antibody dependent cell mediated cytotoxicity (ADCC) (see e.g. Van de Winkel, J. G. and Anderson, C. L., J. Leukoc. Biol. 49 (1991) 511-524). FcRs are defined by their specificity for immunoglobulin isotypes: Fc receptors for IgG antibodies are referred to as FcγR. Fc receptor binding is described e.g. in Ravetch, J. V. and Kinet, J. P., Annu. Rev. Immunol. 9 (1991) 457-492; Capel, P. J., et al., Immunomethods 4 (1994) 25-34; de Haas, M., et al., J. Lab. Clin. Med. 126 (1995) 330-341; and Gessner, J. E., et al., Ann. Hematol. 76 (1998) 231-248.

Cross-linking of receptors for the Fc-region of IgG antibodies (FcγR) triggers a wide variety of effector functions including phagocytosis, antibody-dependent cellular cytotoxicity, and release of inflammatory mediators, as well as immune complex clearance and regulation of antibody production. In humans, three classes of FcγR have been characterized, which are:

FcγRI (CD64) binds monomeric IgG with high affinity and is expressed on macrophages, monocytes, neutrophils and eosinophils. Modification in the Fc-region IgG at least at one of the amino acid residues E233-G236, P238, D265, N297, A327 and P329 (numbering according to EU index of Kabat) reduce binding to FcγRI. IgG2 residues at positions 233-236, substituted into IgG1 and IgG4, reduced binding to FcγRI by $10^3$-fold and eliminated the human monocyte response to antibody-sensitized red blood cells (Armour, K. L., et al., Eur. J. Immunol. 29 (1999) 2613-2624).

FcγRII (CD32) binds complexed IgG with medium to low affinity and is widely expressed. This receptor can be divided into two sub-types, FcγRIIA and FcγRIIB. FcγRIIA is found on many cells involved in killing (e.g. macrophages, monocytes, neutrophils) and seems able to activate the killing process. FcγRIIB seems to play a role in inhibitory processes and is found on B cells, macrophages and on mast cells and eosinophils. On B-cells it seems to function to suppress further immunoglobulin production and isotype switching to, for example, the IgE class. On macrophages, FcγRIIB acts to inhibit phagocytosis as mediated through FcγRIIA. On eosinophils and mast cells the B-form may help to suppress activation of these cells through IgE binding to its separate receptor. Reduced binding for FcγRIIA is found e.g. for antibodies comprising an IgG Fc-region with mutations at least at one of the amino acid residues E233-G236, P238, D265, N297, A327, P329, D270, Q295, A327, R292, and K414 (numbering according to EU index of Kabat).

FcγRIII (CD16) binds IgG with medium to low affinity and exists as two types. FcγRIIIA is found on NK cells, macrophages, eosinophils and some monocytes and T cells and mediates ADCC. Fc γ RIIIB is highly expressed on neutrophils. Reduced binding to FcγRIIIA is found e.g. for antibodies comprising an IgG Fc-region with mutation at least at one of the amino acid residues E233-G236, P238, D265, N297, A327, P329, D270, Q295, A327, S239, E269, E293, Y296, V303, A327, K338 and D376 (numbering according to EU index of Kabat).

Mapping of the binding sites on human IgG1 for Fc receptors, the above mentioned mutation sites and methods for measuring binding to FcγRI and FcγRIIA are described in Shields, R. L., et al. J. Biol. Chem. 276 (2001) 6591-6604.

The term "ADCC" or "antibody-dependent cellular cytotoxicity" is a function mediated by Fc receptor binding and refers to lysis of target cells by an antibody as reported herein in the presence of effector cells. The capacity of the antibody to induce the initial steps mediating ADCC is investigated by measuring their binding to Fcγ receptors expressing cells, such as cells, recombinantly expressing FcγRI and/or FcγRIIA or NK cells (expressing essentially FcγRIIIA) In particular, binding to FcγR on NK cells is measured.

An "activating Fc receptor" is an Fc receptor that following engagement by an Fc region of an antibody elicits signaling events that stimulate the receptor-bearing cell to perform effector functions. Activating Fc receptors include FcγRIIIa (CD16a), FcγRI (CD64), FcγRIIa (CD32), and FcαRI (CD89). A particular activating Fc receptor is human FcγRIIIa (see UniProt accession no. P08637, version 141).

The "Tumor Necrosis factor receptor superfamily" or "TNF receptor superfamily" currently consists of 27 receptors. It is a group of cytokine receptors characterized by the ability to bind tumor necrosis factors (TNFs) via an extracellular cysteine-rich domain (CRD). These pseudorepeats are defined by intrachain disulphides generated by highly conserved cysteine residues within the receptor chains. With the exception of nerve growth factor (NGF), all TNFs are homologous to the archetypal TNF-alpha. In their active form, the majority of TNF receptors form trimeric complexes in the plasma membrane. Accordingly, most TNF receptors contain transmembrane domains (TMDs). Several of these receptors also contain intracellular death domains (DDs) that recruit caspase-interacting proteins following ligand binding to initiate the extrinsic pathway of caspase activation. Other TNF superfamily receptors that lack death domains bind TNF receptor-associated factors and activate intracellular signaling pathways that can lead to proliferation or differentiation. These receptors can also initiate apoptosis, but they do so via indirect mechanisms. In addition to regulating apoptosis, several TNF superfamily receptors are involved in regulating immune cell functions such as B cell homeostasis and activation, natural killer cell activation, and T cell co-stimulation. Several others regulate cell type-specific responses such as hair follicle development and osteoclast development. Members of the TNF receptor superfamily include the following: Tumor necrosis factor receptor 1 (1A) (TNFRSF1A, CD120a), Tumor necrosis factor receptor 2 (1B) (TNFRSF1B, CD120b), Lymphotoxin beta receptor (LTBR, CD18), OX40 (TNFRSF4, CD134), CD40 (Bp50), Fas receptor (Apo-1, CD95, FAS), Decoy receptor 3 (TR6, M68, TNFRSF6B), CD27 (S152, Tp55), CD30 (Ki-1, TNFRSF8), 4-1BB (CD137, TNFRSF9), DR4 (TRAILR1, Apo-2, CD261, TNFRSF10A), DR5 (TRAILR2, CD262, TNFRSF10B), Decoy Receptor 1 (TRAILR3, CD263, TNFRSF10C), Decoy Receptor 2 (TRAILR4, CD264, TNFRSF10D), RANK (CD265, TNFRSF11A), Osteoprotegerin (OCIF, TR1, TNFRSF11B), TWEAK receptor (Fn14, CD266, TNFRSF12A), TACI (CD267, TNFRSF13B), BAFF receptor (CD268, TNFRSF13C), Herpesvirus entry mediator (HVEM, TR2, CD270, TNFRSF14), Nerve growth factor receptor (p75NTR, CD271, NGFR), B-cell maturation antigen (CD269, TNFRSF17), Glucocorticoid-induced TNFR-related (GITR, AITR, CD357, TNFRSF18), TROY (TNFRSF19), DR6 (CD358, TNFRSF21), DR3 (Apo-3, TRAMP, WS-1, TNFRSF25) and Ectodysplasin A2 receptor (XEDAR, EDA2R).

Several members of the tumor necrosis factor receptor (TNFR) family function after initial T cell activation to sustain T cell responses. The term "costimulatory TNF receptor family member" or "costimulatory TNF family receptor" refers to a subgroup of TNF receptor family members, which are able to costimulate proliferation and cytokine production of T-cells. The term refers to any native TNF family receptor from any vertebrate source, including mammals such as primates (e.g. humans), non-human primates (e.g. cynomolgus monkeys) and rodents (e.g. mice and rats), unless otherwise indicated. In specific embodiments of the invention, costimulatory TNF receptor family members are selected from the group consisting of OX40 (CD134), 4-1BB (CD137), CD27, HVEM (CD270), CD30, and GITR, all of which can have costimulatory effects on T cells. More particularly, the costimulatory TNF receptor family member is selected from the group consisting of OX40 and 4-1BB.

Further information, in particular sequences, of the TNF receptor family members may be obtained from publically accessible databases such as Uniprot (www.uniprot.org). For instance, the human costimulatory TNF receptors have the following amino acid sequences: human OX40 (UniProt accession no. P43489, SEQ ID NO:98), human 4-1BB (UniProt accession no. Q07011, SEQ ID NO:99), human CD27 (UniProt accession no. P26842, SEQ ID NO:100), human HVEM (UniProt accession no. Q92956, SEQ ID NO:101), human CD30 (UniProt accession no. P28908, SEQ ID NO:102), and human GITR (UniProt accession no. Q9Y5U5, SEQ ID NO:103).

The term "OX40", as used herein, refers to any native OX40 from any vertebrate source, including mammals such as primates (e.g. humans) and rodents (e.g., mice and rats), unless otherwise indicated. The term encompasses "full-length," unprocessed OX40 as well as any form of OX40 that results from processing in the cell. The term also encompasses naturally occurring variants of OX40, e.g., splice variants or allelic variants. The amino acid sequence of an exemplary human OX40 is shown in SEQ ID NO: 98 (Uniprot P43489, version 112) and the amino acid sequence of an exemplary murine OX40 is shown in SEQ ID NO: 104 (Uniprot P47741, version 101).

The terms "anti-OX40 antibody", "anti-OX40", "OX40 antibody and "an antibody that specifically binds to OX40" refer to an antibody that is capable of binding OX40 with sufficient affinity such that the antibody is useful as a diagnostic and/or therapeutic agent in targeting OX40. In one embodiment, the extent of binding of an anti-OX40 antibody to an unrelated, non-OX40 protein is less than about 10% of the binding of the antibody to OX40 as measured, e.g., by a radioimmunoassay (RIA) or flow cytometry (FACS). In certain embodiments, an antibody that binds to OX40 has a dissociation constant ($K_D$) of ≤1 µM, ≤100 nM, ≤10 nM, ≤1 nM, ≤0.1 nM, ≤0.01 nM, or ≤0.001 nM (e.g. $10^{-6}$M or less, e.g. from $10^{-68}$M to $10^{-13}$M, e.g., from $10^{-8}$M to $10^{-10}$ M).

The term "4-1BB", as used herein, refers to any native 4-1BB from any vertebrate source, including mammals such as primates (e.g. humans) and rodents (e.g., mice and rats), unless otherwise indicated. The term encompasses "full-length," unprocessed 4-1BB as well as any form of 4-1BB that results from processing in the cell. The term also encompasses naturally occurring variants of 4-1BB, e.g., splice variants or allelic variants. The amino acid sequence of an exemplary human 4-1BB is shown in SEQ ID NO: 99 (Uniprot accession no. Q07011), the amino acid sequence of an exemplary murine 4-1BB is shown in SEQ ID NO: 105 (Uniprot accession no. P20334) and the amino acid sequence of an exemplary cynomolgous 4-1BB (from *Macaca mulatta*) is shown in SEQ ID NO:106 (Uniprot accession no. F6W5G6).

The terms "anti-4-1BB antibody", "anti-4-1BB", "4-1BB antibody and "an antibody that specifically binds to 4-1BB" refer to an antibody that is capable of binding 4-1BB with sufficient affinity such that the antibody is useful as a diagnostic and/or therapeutic agent in targeting 4-1BB. In one embodiment, the extent of binding of an anti-4-1BB antibody to an unrelated, non-4-1BB protein is less than about 10% of the binding of the antibody to 4-1BB as measured, e.g., by a radioimmunoassay (RIA) or flow cytometry (FACS). In certain embodiments, an antibody that binds to 4-1BB has a dissociation constant ($K_D$) of ≤1 µM, ≤100 nM, ≤10 nM, ≤1 nM, ≤0.1 nM, ≤0.01 nM, or ≤0.001 nM (e.g. $10^{-6}$M or less, e.g. from $10^{-68}$M to $10^{-13}$M, e.g., from $10^{-8}$M to $10^{-10}$ M).

The term "peptide linker" refers to a peptide comprising one or more amino acids, typically about 2 to 20 amino acids. Peptide linkers are known in the art or are described herein. Suitable, non-immunogenic linker peptides are, for example, $(G_4S)_n$, $(SG_4)_n$ or $G_4(SG_4)_n$ peptide linkers, wherein "n" is generally a number between 1 and 10, typically between 2 and 4, in particular 2, i.e. the peptides selected from the group consisting of GGGGS (SEQ ID NO: 107) GGGGSGGGGS (SEQ ID NO:108), SGGGGSGGGG (SEQ ID NO:109) and GGGGSGGGGSGGGG (SEQ ID NO:110), but also include the sequences GSPGSSSSGS (SEQ ID NO:111), (G4S)$_3$ (SEQ ID NO:112), (G4S)$_4$ (SEQ ID NO:113), GSGSGSGS (SEQ ID NO:114), GSGSGNGS (SEQ ID NO:115), GGSGSGSG (SEQ ID NO:116), GGSGSG (SEQ ID NO:117), GGSG (SEQ ID NO:118), GGSGNGSG (SEQ ID NO:119), GGNGSGSG (SEQ ID NO:120) and GGNGSG (SEQ ID NO:121). Peptide linkers of particular interest are (G4S) (SEQ ID NO:107), $(G_4S)_2$ or GGGGSGGGGS (SEQ ID NO:108) and GSPGSSSSGS (SEQ ID NO:111).

The term "amino acid" as used within this application denotes the group of naturally occurring carboxy α-amino acids comprising alanine (three letter code: ala, one letter code: A), arginine (arg, R), asparagine (asn, N), aspartic acid (asp, D), cysteine (cys, C), glutamine (gln, Q), glutamic acid (glu, E), glycine (gly, G), histidine (his, H), isoleucine (ile, I), leucine (leu, L), lysine (lys, K), methionine (met, M), phenylalanine (phe, F), proline (pro, P), serine (ser, S), threonine (thr, T), tryptophan (trp, W), tyrosine (tyr, Y), and valine (val, V).

By "fused" or "connected" is meant that the components (e.g. a heavy chain of an antibody and a Fab fragment) are linked by peptide bonds, either directly or via one or more peptide linkers.

"Percent (%) amino acid sequence identity" with respect to a reference polypeptide (protein) sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN. SAWI or Megalign (DNASTAR) software. Those skilled in the art can determine appropriate parameters for aligning sequences, including any algorithms needed to achieve maximal alignment over the full length of the sequences being compared. For purposes herein, however, % amino acid sequence identity values are generated using the sequence comparison computer program ALIGN-2. The ALIGN-2 sequence comparison computer program was authored by Genentech, Inc., and the source code has been filed with user documentation in the U.S. Copyright Office, Washington D.C., 20559, where it is registered under U.S. Copyright Registration No. TXU510087. The ALIGN-2 program is publicly available from Genentech, Inc., South San Francisco, Calif., or may be compiled from the source code. The ALIGN-2 program should be compiled for use on a UNIX operating system, including digital UNIX V4.0D. All sequence comparison parameters are set by the ALIGN-2 program and do not vary. In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

$$100 \text{ times the fraction } X/Y$$

where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % amino acid sequence identity values used herein are obtained as described in the immediately preceding paragraph using the ALIGN-2 computer program.

In certain embodiments, amino acid sequence variants of the TNF ligand trimer-containing antigen binding molecules provided herein are contemplated. For example, it may be desirable to improve the binding affinity and/or other biological properties of the TNF ligand trimer-containing antigen binding molecules. Amino acid sequence variants of the TNF ligand trimer-containing antigen binding molecules may be prepared by introducing appropriate modifications into the nucleotide sequence encoding the molecules, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding. Sites of interest for substitutional mutagenesis include the HVRs and Framework (FRs). Conservative substitutions are provided in Table B under the heading "Preferred Substitutions" and further described below in reference to amino acid side chain classes (1) to (6). Amino acid substitutions may be introduced into the molecule of interest and the products screened for a desired activity, e.g., retained/improved antigen binding, decreased immunogenicity, or improved ADCC or CDC.

TABLE B

| Original Residue | Exemplary Substitutions | Preferred Substitutions |
| --- | --- | --- |
| Ala (A) | Val; Leu; Ile | Val |
| Arg (R) | Lys; Gln; Asn | Lys |

TABLE B-continued

| Original Residue | Exemplary Substitutions | Preferred Substitutions |
|---|---|---|
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Amino acids may be grouped according to common side-chain properties:
(1) hydrophobic: Norleucine, Met, Ala, Val, Leu, Ile;
(2) neutral hydrophilic: Cys, Ser, Thr, Asn, Gln;
(3) acidic: Asp, Glu;
(4) basic: His, Lys, Arg;
(5) residues that influence chain orientation: Gly, Pro;
(6) aromatic: Trp, Tyr, Phe.

Non-conservative substitutions will entail exchanging a member of one of these classes for another class.

The term "amino acid sequence variants" includes substantial variants wherein there are amino acid substitutions in one or more hypervariable region residues of a parent antigen binding molecule (e.g. a humanized or human antibody). Generally, the resulting variant(s) selected for further study will have modifications (e.g., improvements) in certain biological properties (e.g., increased affinity, reduced immunogenicity) relative to the parent antigen binding molecule and/or will have substantially retained certain biological properties of the parent antigen binding molecule. An exemplary substitutional variant is an affinity matured antibody, which may be conveniently generated, e.g., using phage display-based affinity maturation techniques such as those described herein. Briefly, one or more HVR residues are mutated and the variant antigen binding molecules displayed on phage and screened for a particular biological activity (e.g. binding affinity). In certain embodiments, substitutions, insertions, or deletions may occur within one or more HVRs so long as such alterations do not substantially reduce the ability of the antigen binding molecule to bind antigen. For example, conservative alterations (e.g., conservative substitutions as provided herein) that do not substantially reduce binding affinity may be made in HVRs. A useful method for identification of residues or regions of an antibody that may be targeted for mutagenesis is called "alanine scanning mutagenesis" as described by Cunningham and Wells (1989) Science, 244:1081-1085. In this method, a residue or group of target residues (e.g., charged residues such as Arg, Asp, His, Lys, and Glu) are identified and replaced by a neutral or negatively charged amino acid (e.g., alanine or polyalanine) to determine whether the interaction of the antibody with antigen is affected. Further substitutions may be introduced at the amino acid locations demonstrating functional sensitivity to the initial substitutions. Alternatively, or additionally, a crystal structure of an antigen-antigen binding molecule complex to identify contact points between the antibody and antigen. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include bispecific antigen binding molecules of the invention with an N-terminal methionyl residue. Other insertional variants of the molecule include the fusion to the N- or C-terminus to a polypeptide which increases the serum half-life of the bispecific antigen binding molecules.

In certain embodiments, the bispecific antigen binding molecules provided herein are altered to increase or decrease the extent to which the antibody is glycosylated. Glycosylation variants of the molecules may be conveniently obtained by altering the amino acid sequence such that one or more glycosylation sites is created or removed. Where the TNF ligand trimer-containing antigen binding molecule comprises an Fc region, the carbohydrate attached thereto may be altered. Native antibodies produced by mammalian cells typically comprise a branched, biantennary oligosaccharide that is generally attached by an N-linkage to Asn297 of the CH2 domain of the Fc region. See, e.g., Wright et al. TIBTECH 15:26-32 (1997). The oligosaccharide may include various carbohydrates, e.g., mannose, N-acetyl glucosamine (GlcNAc), galactose, and sialic acid, as well as a fucose attached to a GlcNAc in the "stem" of the biantennary oligosaccharide structure. In some embodiments, modifications of the oligosaccharide in TNF family ligand trimer-containing antigen binding molecule may be made in order to create variants with certain improved properties. In one aspect, variants of bispecific antigen binding molecules or antibodies of the invention are provided having a carbohydrate structure that lacks fucose attached (directly or indirectly) to an Fc region. Such fucosylation variants may have improved ADCC function, see e.g. US Patent Publication Nos. US 2003/0157108 (Presta, L.) or US 2004/0093621 (Kyowa Hakko Kogyo Co., Ltd). In another aspect, variants of the bispecific antigen binding molecules or antibodies of the invention are provided with bisected oligosaccharides, e.g., in which a biantennary oligosaccharide attached to the Fc region is bisected by GlcNAc. Such variants may have reduced fucosylation and/or improved ADCC function, see for example WO 2003/011878 (Jean-Mairet et al.); U.S. Pat. No. 6,602,684 (Umana et al.); and US 2005/0123546 (Umana et al.). Variants with at least one galactose residue in the oligosaccharide attached to the Fc region are also provided. Such antibody variants may have improved CDC function and are described, e.g., in WO 1997/30087 (Patel et al.); WO 1998/58964 (Raju, S.); and WO 1999/22764 (Raju, S.).

In certain aspects, it may be desirable to create cysteine engineered variants of the bispecific antigen binding molecules of the invention, e.g., "thioMAbs," in which one or more residues of the molecule are substituted with cysteine residues. In particular aspects, the substituted residues occur at accessible sites of the molecule. By substituting those residues with cysteine, reactive thiol groups are thereby positioned at accessible sites of the antibody and may be used to conjugate the antibody to other moieties, such as drug moieties or linker-drug moieties, to create an immunoconjugate. In certain aspects, any one or more of the following residues may be substituted with cysteine: V205

(Kabat numbering) of the light chain; A118 (EU numbering) of the heavy chain; and S400 (EU numbering) of the heavy chain Fc region. Cysteine engineered antigen binding molecules may be generated as described, e.g., in U.S. Pat. No. 7,521,541.

The term "polynucleotide" refers to an isolated nucleic acid molecule or construct, e.g. messenger RNA (mRNA), virally-derived RNA, or plasmid DNA (pDNA). A polynucleotide may comprise a conventional phosphodiester bond or a non-conventional bond (e.g. an amide bond, such as found in peptide nucleic acids (PNA). The term "nucleic acid molecule" refers to any one or more nucleic acid segments, e.g. DNA or RNA fragments, present in a polynucleotide.

By "isolated" nucleic acid molecule or polynucleotide is intended a nucleic acid molecule, DNA or RNA, which has been removed from its native environment. For example, a recombinant polynucleotide encoding a polypeptide contained in a vector is considered isolated for the purposes of the present invention. Further examples of an isolated polynucleotide include recombinant polynucleotides maintained in heterologous host cells or purified (partially or substantially) polynucleotides in solution. An isolated polynucleotide includes a polynucleotide molecule contained in cells that ordinarily contain the polynucleotide molecule, but the polynucleotide molecule is present extrachromosomally or at a chromosomal location that is different from its natural chromosomal location. Isolated RNA molecules include in vivo or in vitro RNA transcripts of the present invention, as well as positive and negative strand forms, and double-stranded forms. Isolated polynucleotides or nucleic acids according to the present invention further include such molecules produced synthetically. In addition, a polynucleotide or a nucleic acid may be or may include a regulatory element such as a promoter, ribosome binding site, or a transcription terminator.

By a nucleic acid or polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These alterations of the reference sequence may occur at the 5' or 3' terminal positions of the reference nucleotide sequence or anywhere between those terminal positions, interspersed either individually among residues in the reference sequence or in one or more contiguous groups within the reference sequence. As a practical matter, whether any particular polynucleotide sequence is at least 80%, 85%, 90%, 95%, 96%, 97%, 98% or 99% identical to a nucleotide sequence of the present invention can be determined conventionally using known computer programs, such as the ones discussed above for polypeptides (e.g. ALIGN-2).

The term "expression cassette" refers to a polynucleotide generated recombinantly or synthetically, with a series of specified nucleic acid elements that permit transcription of a particular nucleic acid in a target cell. The recombinant expression cassette can be incorporated into a plasmid, chromosome, mitochondrial DNA, plastid DNA, virus, or nucleic acid fragment. Typically, the recombinant expression cassette portion of an expression vector includes, among other sequences, a nucleic acid sequence to be transcribed and a promoter. In certain embodiments, the expression cassette of the invention comprises polynucleotide sequences that encode bispecific antigen binding molecules of the invention or fragments thereof.

The term "vector" or "expression vector" is synonymous with "expression construct" and refers to a DNA molecule that is used to introduce and direct the expression of a specific gene to which it is operably associated in a target cell. The term includes the vector as a self-replicating nucleic acid structure as well as the vector incorporated into the genome of a host cell into which it has been introduced. The expression vector of the present invention comprises an expression cassette. Expression vectors allow transcription of large amounts of stable mRNA. Once the expression vector is inside the target cell, the ribonucleic acid molecule or protein that is encoded by the gene is produced by the cellular transcription and/or translation machinery. In one embodiment, the expression vector of the invention comprises an expression cassette that comprises polynucleotide sequences that encode bispecific antigen binding molecules of the invention or fragments thereof.

The terms "host cell", "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein. A host cell is any type of cellular system that can be used to generate the bispecific antigen binding molecules of the present invention. Host cells include cultured cells, e.g. mammalian cultured cells, such as CHO cells, BHK cells, NS0 cells, SP2/0 cells, YO myeloma cells, P3X63 mouse myeloma cells, PER cells, PER.C6 cells or hybridoma cells, yeast cells, insect cells, and plant cells, to name only a few, but also cells comprised within a transgenic animal, transgenic plant or cultured plant or animal tissue.

An "effective amount" of an agent refers to the amount that is necessary to result in a physiological change in the cell or tissue to which it is administered.

A "therapeutically effective amount" of an agent, e.g. a pharmaceutical composition, refers to an amount effective, at dosages and for periods of time necessary, to achieve the desired therapeutic or prophylactic result. A therapeutically effective amount of an agent for example eliminates, decreases, delays, minimizes or prevents adverse effects of a disease.

An "individual" or "subject" is a mammal. Mammals include, but are not limited to, domesticated animals (e.g. cows, sheep, cats, dogs, and horses), primates (e.g. humans and non-human primates such as monkeys), rabbits, and rodents (e.g. mice and rats). Particularly, the individual or subject is a human.

The term "pharmaceutical composition" refers to a preparation which is in such form as to permit the biological activity of an active ingredient contained therein to be effective, and which contains no additional components which are unacceptably toxic to a subject to which the formulation would be administered.

A "pharmaceutically acceptable excipient" refers to an ingredient in a pharmaceutical composition, other than an active ingredient, which is nontoxic to a subject. A pharmaceutically acceptable excipient includes, but is not limited to, a buffer, a stabilizer, or a preservative.

The term "package insert" is used to refer to instructions customarily included in commercial packages of therapeutic products, that contain information about the indications, usage, dosage, administration, combination therapy, contraindications and/or warnings concerning the use of such therapeutic products.

As used herein, "treatment" (and grammatical variations thereof such as "treat" or "treating") refers to clinical intervention in an attempt to alter the natural course of the individual being treated, and can be performed either for prophylaxis or during the course of clinical pathology. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. In some embodiments, the molecules of the invention are used to delay development of a disease or to slow the progression of a disease.

The term "cancer" as used herein refers to proliferative diseases, such as lymphomas, lymphocytic leukemias, lung cancer, non-small cell lung (NSCL) cancer, bronchioloalviolar cell lung cancer, bone cancer, pancreatic cancer, skin cancer, cancer of the head or neck, cutaneous or intraocular melanoma, uterine cancer, ovarian cancer, rectal cancer, cancer of the anal region, stomach cancer, gastric cancer, colon cancer, breast cancer, uterine cancer, carcinoma of the fallopian tubes, carcinoma of the endometrium, carcinoma of the cervix, carcinoma of the vagina, carcinoma of the vulva, Hodgkin's Disease, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, prostate cancer, cancer of the bladder, cancer of the kidney or ureter, renal cell carcinoma, carcinoma of the renal pelvis, mesothelioma, hepatocellular cancer, biliary cancer, neoplasms of the central nervous system (CNS), spinal axis tumors, brain stem glioma, glioblastoma multiforme, astrocytomas, schwanomas, ependymonas, medulloblastomas, meningiomas, squamous cell carcinomas, pituitary adenoma and Ewings sarcoma, including refractory versions of any of the above cancers, or a combination of one or more of the above cancers.

Bispecific Antibodies of the Invention

The invention provides novel biospecific antigen binding molecules with particularly advantageous properties such as producibility, stability, binding affinity, biological activity, targeting efficiency and reduced toxicity.

Exemplary Bispecific Antigen Binding Molecules

In one aspect, the invention provides bispecific antigen binding molecules, comprising
 (a) at least one moiety capable of specific binding to a costimulatory TNF receptor family member,
 (b) at least one moiety capable of specific binding to a target cell antigen, and
 (c) a Fc domain composed of a first and a second subunit capable of stable association.

In a particular aspect, these bispecific antigen binding molecules are characterized by agonistic binding to a costimulatory TNF receptor family member. Particularly, the costimulatory TNF receptor family member is selected from the group consisting of OX40 and 4-1BB.

Bispecific Antigen Binding Molecules Binding to OX40

In one aspect, the costimulatory TNF receptor family member is OX40. Particularly, the invention provides bispecific antigen binding molecules, wherein the moiety capable of specific binding to a costimulatory TNF receptor family member binds to a polypeptide comprising the amino acid sequence of SEQ ID NO:1.

In one aspect, provided is a bispecific antigen binding molecule, comprising at least one moiety capable of specific binding to OX40, wherein said moiety comprises a VH domain comprising
 (i) a CDR-H1 comprising the amino acid sequence selected from the group consisting of SEQ ID NO:2 and SEQ ID NO:3,
 (ii) a CDR-H2 comprising the amino acid sequence selected from the group consisting of SEQ ID NO:4 and SEQ ID NO:5, and
 (iii) a CDR-H3 comprising the amino acid sequence selected from the group consisting of SEQ ID NO:6, SEQ ID NO:7, SEQ ID NO:8, SEQ ID NO: 9, SEQ ID NO:10, SEQ ID NO:11 and SEQ ID NO:12,
and a VL domain comprising
 (iv) a CDR-L1 comprising the amino acid sequence selected from the group consisting of SEQ ID NO:13, SEQ ID NO:14 and SEQ ID NO:15,
 (v) a CDR-L2 comprising the amino acid sequence selected from the group consisting of SEQ ID NO:16, SEQ ID NO:17 and SEQ ID NO:18, and
 (vi) a CDR-L3 comprising the amino acid sequence selected from the group consisting of SEQ ID NO:19, SEQ ID NO:20, SEQ ID NO:21, SEQ ID NO:22, SEQ ID NO:23 and SEQ ID NO:24.

In particular, provided is a bispecific antigen binding molecule, comprising at least one moiety capable of specific binding to OX40, wherein said moiety comprises
 (a) a VH domain comprising CDR-H1 comprising the amino acid sequence of SEQ ID NO:2, CDR-H2 comprising the amino acid sequence of SEQ ID NO:4, CDR-H3 comprising the amino acid sequence of SEQ ID NO:6 and a VL domain comprising CDR-L1 comprising the amino acid sequence of SEQ ID NO:13, CDR-H2 comprising the amino acid sequence of SEQ ID NO:16 and CDR-H3 comprising the amino acid sequence of SEQ ID NO:19,
 (b) a VH domain comprising CDR-H1 comprising the amino acid sequence of SEQ ID NO:2, CDR-H2 comprising the amino acid sequence of SEQ ID NO:4, CDR-H3 comprising the amino acid sequence of SEQ ID NO:7 and a VL domain comprising CDR-L1 comprising the amino acid sequence of SEQ ID NO:13, CDR-H2 comprising the amino acid sequence of SEQ ID NO:16 and CDR-H3 comprising the amino acid sequence of SEQ ID NO:20,
 (c) a VH domain comprising CDR-H1 comprising the amino acid sequence of SEQ ID NO:2, CDR-H2 comprising the amino acid sequence of SEQ ID NO:4, CDR-H3 comprising the amino acid sequence of SEQ ID NO:8 and a VL domain comprising CDR-L1 comprising the amino acid sequence of SEQ ID NO:13, CDR-H2 comprising the amino acid sequence of SEQ ID NO:16 and CDR-H3 comprising the amino acid sequence of SEQ ID NO:21,
 (d) a VH domain comprising CDR-H1 comprising the amino acid sequence of SEQ ID NO:2, CDR-H2 comprising the amino acid sequence of SEQ ID NO:4, CDR-H3 comprising the amino acid sequence of SEQ ID NO:9 and a VL domain comprising CDR-L1 comprising the amino acid sequence of SEQ ID NO:13, CDR-H2 comprising the amino acid sequence of SEQ ID NO:16 and CDR-H3 comprising the amino acid sequence of SEQ ID NO:22, (e) a VH domain comprising CDR-H1 comprising the amino acid sequence of SEQ ID NO:3, CDR-H2 comprising the amino acid sequence of SEQ ID NO:5, CDR-H3 comprising the amino acid sequence of SEQ ID NO:10 and a VL domain comprising CDR-L1 comprising the amino acid sequence of SEQ ID NO:14, CDR-H2 comprising the amino acid sequence of SEQ ID NO:17 and CDR-H3 comprising the amino acid sequence of SEQ ID NO:23, (f) a VH domain comprising CDR-H1 comprising the amino acid sequence of SEQ ID NO:3, CDR-H2 comprising the amino acid sequence of SEQ ID NO:5, CDR-H3 comprising the amino acid sequence of SEQ ID NO:11 and a VL domain comprising CDR-L1 comprising the amino acid sequence of SEQ ID NO:14, CDR-H2 comprising the amino acid sequence of SEQ ID NO:17 and CDR-H3 comprising the amino acid sequence of SEQ ID NO:23, or (g) a VH domain comprising CDR-H1 comprising the amino acid sequence of SEQ ID NO:3, CDR-H2 comprising the amino acid sequence of SEQ ID NO:5, CDR-H3 comprising the amino acid sequence of SEQ ID NO:12 and a VL domain comprising CDR-L1 comprising the amino acid sequence of SEQ ID NO:15, CDR-H2 comprising the amino acid sequence of SEQ ID NO:18 and CDR-H3 comprising the amino acid sequence of SEQ ID NO:24.

In one aspect, the invention provides a bispecific antigen binding molecule, comprising at least one moiety capable of specific binding to OX40, wherein said moiety comprises a VH domain comprising CDR-H1 comprising the amino acid sequence of SEQ ID NO:2, CDR-H2 comprising the amino acid sequence of SEQ ID NO:4, CDR-H3 comprising the amino acid sequence of SEQ ID NO:7 and a VL domain comprising CDR-L1 comprising the amino acid sequence of SEQ ID NO:13, CDR-H2 comprising the amino acid sequence of SEQ ID NO:16 and CDR-H3 comprising the amino acid sequence of SEQ ID NO:20.

In another aspect, the invention provides a bispecific antigen binding molecule, wherein the moiety capable of specific binding to OX40 comprises a heavy chain variable region VH comprising an amino acid sequence that is at least about 95%, 96%, 97%, 98%, 99% or 100% identical to an amino acid sequence selected from the group consisting of SEQ ID NO:25, SEQ ID NO: 27, SEQ ID NO:29, SEQ ID NO:31, SEQ ID NO:33, SEQ ID NO:35 and SEQ ID NO:37 and a light chain variable region VL comprising an amino acid sequence that is at least about 95%, 96%, 97%, 98%, 99% or 100% identical to an amino acid sequence of SEQ ID NO:26, SEQ ID NO: 28, SEQ ID NO:30, SEQ ID NO:30, SEQ ID NO:32, SEQ ID NO:34, SEQ ID NO:36 and SEQ ID NO:38.

Particularly, provided is a bispecific antigen binding molecule, wherein the moiety capable of specific binding to OX40 comprises (i) a heavy chain variable region VH comprising an amino acid sequence of SEQ ID NO:25 and a light chain variable region VL comprising an amino acid sequence of SEQ ID NO:26, (ii) a heavy chain variable region VH comprising an amino acid sequence of SEQ ID NO:27 and a light chain variable region VL comprising an amino acid sequence of SEQ ID NO:28, (iii) a heavy chain variable region VH comprising an amino acid sequence of SEQ ID NO:29 and a light chain variable region VL comprising an amino acid sequence of SEQ ID NO:30, (iv) a heavy chain variable region VH comprising an amino acid sequence of SEQ ID NO:31 and a light chain variable region VL comprising an amino acid sequence of SEQ ID NO:32, (v) a heavy chain variable region VH comprising an amino acid sequence of SEQ ID NO:33 and a light chain variable region VL comprising an amino acid sequence of SEQ ID NO:34, (vi) a heavy chain variable region VH comprising an amino acid sequence of SEQ ID NO:35 and a light chain variable region VL comprising an amino acid sequence of SEQ ID NO:36, or (vii) a heavy chain variable region VH comprising an amino acid sequence of SEQ ID NO:37 and a light chain variable region VL comprising an amino acid sequence of SEQ ID NO:38.

In a particular aspect, provided is a bispecific antigen binding molecule, wherein the moiety capable of specific binding to OX40 comprises a heavy chain variable region VH comprising an amino acid sequence of SEQ ID NO:27 and a light chain variable region VL comprising an amino acid sequence of SEQ ID NO:28.

Bispecific Antigen Binding Molecules Binding to 4-1BB

In another aspect, the costimulatory TNF receptor family member is 4-1BB. Particularly, the invention provides bispecific antigen binding molecules, wherein the moiety capable of specific binding to a costimulatory TNF receptor family member binds to a polypeptide comprising the amino acid sequence of SEQ ID NO:39.

In one aspect, provided is a bispecific antigen binding molecule, comprising at least one moiety capable of specific binding to 4-1BB, wherein said moiety comprises a VH domain comprising (i) a CDR-H1 comprising the amino acid sequence selected from the group consisting of SEQ ID NO:40 and SEQ ID NO:41, (ii) a CDR-H2 comprising the amino acid sequence selected from the group consisting of SEQ ID NO:42 and SEQ ID NO:43, and (iii) a CDR-H3 comprising the amino acid sequence selected from the group consisting of SEQ ID NO:44, SEQ ID NO:45, SEQ ID NO:46, SEQ ID NO:47 and SEQ ID NO:48 and a VL domain comprising (iv) a CDR-L1 comprising the amino acid sequence selected from the group consisting of SEQ ID NO:49 and SEQ ID NO:50, (v) a CDR-L2 comprising the amino acid sequence selected from the group consisting of SEQ ID NO:51 and SEQ ID NO:52, and (vi) a CDR-L3 comprising the amino acid sequence selected from the group consisting of SEQ ID NO:53, SEQ ID NO:54, SEQ ID NO:55, SEQ ID NO:56 and SEQ ID NO:57.

In particular, provided is a bispecific antigen binding molecule, comprising at least one moiety capable of specific binding to 4-1BB, wherein said moiety comprises (a) a VH domain comprising CDR-H1 comprising the amino acid sequence of SEQ ID NO:40, CDR-H2 comprising the amino acid sequence of SEQ ID NO:42, CDR-H3 comprising the amino acid sequence of SEQ ID NO:44 and a VL domain comprising CDR-L1 comprising the amino acid sequence of SEQ ID NO:49, CDR-H2 comprising the amino acid sequence of SEQ ID NO:51 and CDR-H3 comprising the amino acid sequence of SEQ ID NO:53, (b) a VH domain comprising CDR-H1 comprising the amino acid sequence of SEQ ID NO:41, CDR-H2 comprising the amino acid sequence of SEQ ID NO:43, CDR-H3 comprising the amino acid sequence of SEQ ID NO:45 and a VL domain comprising CDR-L1 comprising the amino acid sequence of SEQ ID NO:50, CDR-H2 comprising the amino acid sequence of SEQ ID NO:52 and CDR-H3 comprising the amino acid sequence of SEQ ID NO:54, (c) a VH domain comprising CDR-H1 comprising the amino acid sequence of SEQ ID NO:40, CDR-H2 comprising the amino acid sequence of SEQ ID NO:42, CDR-H3 comprising the amino acid sequence of SEQ ID NO:46 and a VL domain comprising CDR-L1 comprising the amino acid sequence of SEQ ID NO:49, CDR-H2 comprising the amino acid sequence of SEQ ID NO:51 and CDR-H3 comprising the amino acid sequence of SEQ ID NO:55, (d) a VH domain comprising CDR-H1 comprising the amino acid sequence of SEQ ID NO:40, CDR-H2 comprising the amino acid sequence of SEQ ID NO:42, CDR-H3 comprising the amino acid sequence of SEQ ID NO:47 and a VL domain comprising CDR-L1 comprising the amino acid sequence of SEQ ID NO:49, CDR-H2 comprising the amino acid sequence of SEQ ID NO:51 and CDR-H3 comprising the amino acid sequence of SEQ ID NO:56, or (e) a VH domain comprising CDR-H1 comprising the amino acid sequence of SEQ ID NO:40, CDR-H2 comprising the amino acid sequence of SEQ ID NO:42, CDR-H3 comprising the amino acid sequence of SEQ ID NO:48 and a VL domain comprising CDR-L1 comprising the amino acid sequence of SEQ ID NO:49, CDR-H2 comprising the amino acid sequence of SEQ ID NO:51 and CDR-H3 comprising the amino acid sequence of SEQ ID NO:57.

In another aspect, the invention provides a bispecific antigen binding molecule, wherein the moiety capable of specific binding to 4-1BB comprises a heavy chain variable region VH comprising an amino acid sequence that is at least about 95%, 96%, 97%, 98%, 99% or 100% identical to an amino acid sequence selected from the group consisting of SEQ ID NO:58, SEQ ID NO:60, SEQ ID NO:62, SEQ ID NO:64 and SEQ ID NO:66 and a light chain variable region comprising an amino acid sequence that is at least about 95%, 96%, 97%, 98%, 99% or 100% identical to an amino acid sequence selected from the group consisting of SEQ ID NO:59, SEQ ID NO:61, SEQ ID NO:63, SEQ ID NO:65 and SEQ ID NO:67.

Particularly, provided is a bispecific antigen binding molecule, wherein the moiety capable of specific binding to 4-1BB comprises
(i) a heavy chain variable region VH comprising an amino acid sequence of SEQ ID NO:58 and and a light chain variable region VL comprising an amino acid sequence of SEQ ID NO:59,
(ii) a heavy chain variable region VH comprising an amino acid sequence of SEQ ID NO:60 and and a light chain variable region VL comprising an amino acid sequence of SEQ ID NO:61,
(iii) a heavy chain variable region VH comprising an amino acid sequence of SEQ ID NO:62 and and a light chain variable region VL comprising an amino acid sequence of SEQ ID NO:63,
(iv) a heavy chain variable region VH comprising an amino acid sequence of SEQ ID NO:64 and and a light chain variable region VL comprising an amino acid sequence of SEQ ID NO:65, or
(v) a heavy chain variable region VH comprising an amino acid sequence of SEQ ID NO:66 and and a light chain variable region VL comprising an amino acid sequence of SEQ ID NO:67.

The bispecific antigen binding molecules of the invention are further characterized by comprising at least one moiety capable of specific binding to a target cell antigen. The bispecific antigen binding molecules thus possess the advantage over conventional antibodies capable of specific binding to a costimulatory TNF receptor family member, that they selectively induce a costimulatory T cell response at the target cells, which are typically cancer cells. In one aspect, the target cell antigen is selected from the group consisting of Fibroblast Activation Protein (FAP), Melanoma-associated Chondroitin Sulfate Proteoglycan (MCSP), Epidermal Growth Factor Receptor (EGFR), Carcinoembryonic Antigen (CEA), CD19, CD20 and CD33.

Bispecific Antigen Binding Molecules Wherein the Target Cell Antigen is FAP

In a particular aspect, the target cell antigen is Fibroblast Activation Protein (FAP). FAP binding moieties have been described in WO 2012/02006 which is included by reference in its entirety. FAP binding moieties of particular interest are described below.

In one aspect, the invention provides a bispecific antigen binding molecule, wherein the moiety capable of specific binding to FAP comprises a VH domain comprising
(i) a CDR-H1 comprising the amino acid sequence selected from the group consisting of SEQ ID NO:68 and SEQ ID NO:69,
(ii) a CDR-H2 comprising the amino acid sequence selected from the group consisting of SEQ ID NO:70 and SEQ ID NO:71, and
(iii) a CDR-H3 comprising the amino acid sequence selected from the group consisting of SEQ ID NO:72 and SEQ ID NO:73,
and a VL domain comprising
(iv) a CDR-L1 comprising the amino acid sequence selected from the group consisting of SEQ ID NO:74 and SEQ ID NO:75,
(v) a CDR-L2 comprising the amino acid sequence selected from the group consisting of SEQ ID NO:76 and SEQ ID NO:77, and
(vi) a CDR-L3 comprising the amino acid sequence selected from the group consisting of SEQ ID NO:78 and SEQ ID NO:79.

In particular, provided is a bispecific antigen binding molecule, wherein the moiety capable of specific binding to FAP comprises
(a) a VH domain comprising CDR-H1 comprising the amino acid sequence of SEQ ID NO:68, CDR-H2 comprising the amino acid sequence of SEQ ID NO:70, CDR-H3 comprising the amino acid sequence of SEQ ID NO:72 and a VL domain comprising CDR-L1 comprising the amino acid sequence of SEQ ID NO:74, CDR-H2 comprising the amino acid sequence of SEQ ID NO:76 and CDR-H3 comprising the amino acid sequence of SEQ ID NO:78, or
(b) a VH domain comprising CDR-H1 comprising the amino acid sequence of SEQ ID NO:69, CDR-H2 comprising the amino acid sequence of SEQ ID NO:71, CDR-H3 comprising the amino acid sequence of SEQ ID NO:73 and a VL domain comprising CDR-L1 comprising the amino acid sequence of SEQ ID NO:75, CDR-H2 comprising the amino acid sequence of SEQ ID NO:77 and CDR-H3 comprising the amino acid sequence of SEQ ID NO:79.

In a particular aspect, the moiety capable of specific binding to FAP comprises a VH domain comprising CDR-H1 comprising the amino acid sequence of SEQ ID NO:69, CDR-H2 comprising the amino acid sequence of SEQ ID NO:71, CDR-H3 comprising the amino acid sequence of SEQ ID NO:73 and a VL domain comprising CDR-L1 comprising the amino acid sequence of SEQ ID NO:75, CDR-H2 comprising the amino acid sequence of SEQ ID NO:77 and CDR-H3 comprising the amino acid sequence of SEQ ID NO:79.

Particularly, provided is a bispecific antigen binding molecule, wherein the moiety capable of specific binding to FAP comprises
   (i) a heavy chain variable region VH comprising an amino acid sequence of SEQ ID NO:80 and and a light chain variable region VL comprising an amino acid sequence of SEQ ID NO:81, or
   (ii) a heavy chain variable region VH comprising an amino acid sequence of SEQ ID NO:82 and and a light chain variable region VL comprising an amino acid sequence of SEQ ID NO:83.

Bispecific Antigen Binding Molecules Binding to OX40 and FAP

In a further aspect, provided is a bispecific antigen binding molecule, wherein
(i) the moiety capable of specific binding to OX40 comprises a heavy chain variable region VH comprising an amino acid sequence that is at least about 95%, 96%, 97%, 98%, 99% or 100% identical to the amino acid sequence of SEQ ID NO:25, SEQ ID NO: 27, SEQ ID NO:29, SEQ ID NO:31, SEQ ID NO:33, SEQ ID NO:35 or SEQ ID NO:37 and a light chain variable region comprising an amino acid sequence that is at least about 95%, 96%, 97%, 98%, 99% or 100% identical to the amino acid sequence of SEQ ID NO:26, SEQ ID NO: 28, SEQ ID NO:30, SEQ ID NO:32, SEQ ID NO:34, SEQ ID NO:36 or SEQ ID NO:38 and
(ii) the moiety capable of specific binding to FAP comprises a heavy chain variable region VH comprising an amino acid sequence that is at least about 95%, 96%, 97%, 98%, 99% or 100% identical to the amino acid sequence of SEQ ID NO:80 or SEQ ID NO:82 and a light chain variable region comprising an amino acid sequence that is at least about 95%, 96%, 97%, 98%, 99% or 100% identical to the amino acid sequence of SEQ ID NO:81 or SEQ ID NO:83.

In a particular aspect, provided is a bispecific antigen binding molecule, wherein
(a) the moiety capable of specific binding to OX40 comprises a heavy chain variable region VH comprising an amino acid sequence of SEQ ID NO:25 and a light chain variable region comprising an amino acid sequence of SEQ ID NO:26 and the moiety capable of specific binding to FAP comprises a heavy chain variable region VH comprising an amino acid sequence of SEQ ID NO:80 and a light chain variable region comprising an amino acid sequence of SEQ ID NO:81,
(b) the moiety capable of specific binding to OX40 comprises a heavy chain variable region VH comprising an amino acid sequence of SEQ ID NO:25 and a light chain variable region comprising an amino acid sequence of SEQ ID NO:26 and the moiety capable of specific binding to FAP comprises a heavy chain variable region VH comprising an amino acid sequence of SEQ ID NO:82 and a light chain variable region comprising an amino acid sequence of SEQ ID NO:83,
(c) the moiety capable of specific binding to OX40 comprises a heavy chain variable region VH comprising an amino acid sequence of SEQ ID NO:27 and a light chain variable region comprising an amino acid sequence of SEQ ID NO:28 and the moiety capable of specific binding to FAP comprises a heavy chain variable region VH comprising an amino acid sequence of SEQ ID NO:80 and a light chain variable region comprising an amino acid sequence of SEQ ID NO:81,
(d) the moiety capable of specific binding to OX40 comprises a heavy chain variable region VH comprising an amino acid sequence of SEQ ID NO:27 and a light chain variable region comprising an amino acid sequence of SEQ ID NO:28 and the moiety capable of specific binding to FAP comprises a heavy chain variable region VH comprising an amino acid sequence of SEQ ID NO:82 and a light chain variable region comprising an amino acid sequence of SEQ ID NO:83,
(e) the moiety capable of specific binding to OX40 comprises a heavy chain variable region VH comprising an amino acid sequence of SEQ ID NO:29 and a light chain variable region comprising an amino acid sequence of SEQ ID NO:30 and the moiety capable of specific binding to FAP comprises a heavy chain variable region VH comprising an amino acid sequence of SEQ ID NO:80 and a light chain variable region comprising an amino acid sequence of SEQ ID NO:81,
(f) the moiety capable of specific binding to OX40 comprises a heavy chain variable region VH comprising an amino acid sequence of SEQ ID NO:29 and a light chain variable region comprising an amino acid sequence of SEQ ID NO:30 and the moiety capable of specific binding to FAP comprises a heavy chain variable region VH comprising an amino acid sequence of SEQ ID NO:82 and a light chain variable region comprising an amino acid sequence of SEQ ID NO:83,
(g) the moiety capable of specific binding to OX40 comprises a heavy chain variable region VH comprising an amino acid sequence of SEQ ID NO:31 and a light chain variable region comprising an amino acid sequence of SEQ ID NO:32 and the moiety capable of specific binding to FAP comprises a heavy chain variable region VH comprising an amino acid sequence of SEQ ID NO:80 and a light chain variable region comprising an amino acid sequence of SEQ ID NO:81,
(h) the moiety capable of specific binding to OX40 comprises a heavy chain variable region VH comprising an amino acid sequence of SEQ ID NO:31 and a light chain variable region comprising an amino acid sequence of SEQ ID NO:32 and the moiety capable of specific binding to FAP comprises a heavy chain variable region VH comprising an amino acid sequence of SEQ ID NO:82 and a light chain variable region comprising an amino acid sequence of SEQ ID NO:83,
(i) the moiety capable of specific binding to OX40 comprises a heavy chain variable region VH comprising an amino acid sequence of SEQ ID NO:33 and a light chain variable region comprising an amino acid sequence of SEQ ID NO:34 and the moiety capable of specific binding to FAP comprises a heavy chain variable region VH comprising an amino acid sequence of SEQ ID NO:80 and a light chain variable region comprising an amino acid sequence of SEQ ID NO:81,
(j) the moiety capable of specific binding to OX40 comprises a heavy chain variable region VH comprising an amino acid sequence of SEQ ID NO:33 and a light chain variable region comprising an amino acid sequence of SEQ ID NO:34 and the moiety capable of specific binding to FAP comprises a heavy chain variable region VH comprising an amino acid sequence of SEQ ID NO:82 and a light chain variable region comprising an amino acid sequence of SEQ ID NO:83,
(k) the moiety capable of specific binding to OX40 comprises a heavy chain variable region VH comprising an amino acid sequence of SEQ ID NO:35 and a light chain variable region comprising an amino acid sequence of SEQ ID NO:36 and the moiety capable of specific binding to FAP comprises a heavy chain variable region VH comprising an amino acid sequence of SEQ ID NO:80 and a light chain variable region comprising an amino acid sequence of SEQ ID NO:81, (l) the moiety capable of specific binding to OX40 comprises a heavy chain variable region VH comprising an amino acid sequence of SEQ ID NO:35 and a light chain variable region comprising an amino acid sequence of SEQ ID NO:36 and the moiety capable of specific binding to FAP comprises a heavy chain variable region VH comprising an amino acid sequence of SEQ ID NO:82 and a light chain variable region comprising an amino acid sequence of SEQ ID NO:83, (m) the moiety capable of specific binding to OX40 comprises a heavy chain variable region VH comprising an amino acid sequence of SEQ ID NO:37 and a light chain variable region comprising an amino acid sequence of SEQ ID NO:38 and the moiety capable of specific binding to FAP comprises a heavy chain variable region VH comprising an amino acid sequence of SEQ ID NO:80 and a light chain variable region comprising an amino acid sequence of SEQ ID NO:81, or (n) the moiety capable of specific binding to OX40 comprises a heavy chain variable region VH comprising an amino acid sequence of SEQ ID NO:37 and a light chain variable region comprising an amino acid sequence of SEQ ID NO:38 and the moiety capable of specific binding to FAP comprises a heavy chain variable region VH comprising an amino acid sequence of SEQ ID NO:82 and a light chain variable region comprising an amino acid sequence of SEQ ID NO:83.

In a particular aspect, the invention provides a bispecific antigen binding molecule, wherein the moiety capable of specific binding to OX40 comprises a heavy chain variable region VH comprising an amino acid sequence of SEQ ID NO:27 and a light chain variable region comprising an amino acid sequence of SEQ ID NO:28 and the moiety capable of specific binding to FAP comprises a heavy chain variable region VH comprising an amino acid sequence of SEQ ID NO:80 and a light chain variable region comprising an amino acid sequence of SEQ ID NO:81, or wherein the moiety capable of specific binding to OX40 comprises a heavy chain variable region VH comprising an amino acid sequence of SEQ ID NO:27 and a light chain variable region comprising an amino acid sequence of SEQ ID NO:28 and the moiety capable of specific binding to FAP comprises a heavy chain variable region VH comprising an amino acid sequence of SEQ ID NO:82 and a light chain variable region comprising an amino acid sequence of SEQ ID NO:83.

Bispecific Antigen Binding Molecules Binding to 4-1BB and FAP

In another aspect, provided is a bispecific antigen binding molecule, wherein (i) the moiety capable of specific binding to 4-1BB comprises a heavy chain variable region VH comprising an amino acid sequence that is at least about 95%, 96%, 97%, 98%, 99% or 100% identical to the amino acid sequence of SEQ ID NO:58, SEQ ID NO:60, SEQ ID NO:62, SEQ ID NO:64 or SEQ ID NO:66 and a light chain variable region comprising an amino acid sequence that is at least about 95%, 96%, 97%, 98%, 99% or 100% identical to the amino acid sequence of SEQ ID NO:59, SEQ ID NO:61, SEQ ID NO:63, SEQ ID NO:65 or SEQ ID NO:67 and (ii) the moiety capable of specific binding to FAP comprises a heavy chain variable region VH comprising an amino acid sequence that is at least about 95%, 96%, 97%, 98%, 99% or 100% identical to the amino acid sequence of SEQ ID NO:80 or SEQ ID NO:82 and a light chain variable region comprising an amino acid sequence that is at least about 95%, 96%, 97%, 98%, 99% or 100% identical to the amino acid sequence of SEQ ID NO:81 or SEQ ID NO:83.

In a particular aspect, provided is a bispecific antigen binding molecule, wherein (a) the moiety capable of specific binding to 4-1BB comprises a heavy chain variable region VH comprising an amino acid sequence of SEQ ID NO:58 and a light chain variable region comprising an amino acid sequence of SEQ ID NO:59 and the moiety capable of specific binding to FAP comprises a heavy chain variable region VH comprising an amino acid sequence of SEQ ID NO:80 and a light chain variable region comprising an amino acid sequence of SEQ ID NO:81, (b) the moiety capable of specific binding to 4-1BB comprises a heavy chain variable region VH comprising an amino acid sequence of SEQ ID NO:58 and a light chain variable region comprising an amino acid sequence of SEQ ID NO:95 and the moiety capable of specific binding to FAP comprises a heavy chain variable region VH comprising an amino acid sequence of SEQ ID NO:82 and a light chain variable region comprising an amino acid sequence of SEQ ID NO:83, (c) the moiety capable of specific binding to 4-1BB comprises a heavy chain variable region VH comprising an amino acid sequence of SEQ ID NO:60 and a light chain variable region comprising an amino acid sequence of SEQ ID NO:61 and the moiety capable of specific binding to FAP comprises a heavy chain variable region VH comprising an amino acid sequence of SEQ ID NO:80 and a light chain variable region comprising an amino acid sequence of SEQ ID NO:81, (d) the moiety capable of specific binding to 4-1BB comprises a heavy chain variable region VH comprising an amino acid sequence of SEQ ID NO:60 and a light chain variable region comprising an amino acid sequence of SEQ ID NO:61 and the moiety capable of specific binding to FAP comprises a heavy chain variable region VH comprising an amino acid sequence of SEQ ID NO:82 and a light chain variable region comprising an amino acid sequence of SEQ ID NO:83, (e) the moiety capable of specific binding to 4-1BB comprises a heavy chain variable region VH comprising an amino acid sequence of SEQ ID NO:62 and a light chain variable region comprising an amino acid sequence of SEQ ID NO:63 and the moiety capable of specific binding to FAP comprises a heavy chain variable region VH comprising an amino acid sequence of SEQ ID NO:80 and a light chain variable region comprising an amino acid sequence of SEQ ID NO:81, (f) the moiety capable of specific binding to 4-1BB comprises a heavy chain variable region VH comprising an amino acid sequence of SEQ ID NO:62 and a light chain variable region comprising an amino acid sequence of SEQ ID NO:63 and the moiety capable of specific binding to FAP comprises a heavy chain variable region VH comprising an amino acid sequence of SEQ ID NO:82 and a light chain variable region comprising an amino acid sequence of SEQ ID NO:83, (g) the moiety capable of specific binding to 4-1BB comprises a heavy chain variable region VH comprising an amino acid sequence of SEQ ID NO:64 and a light chain variable region comprising an amino acid sequence of SEQ ID NO:65 and the moiety capable of specific binding to FAP comprises a heavy chain variable region VH comprising an amino acid sequence of SEQ ID NO:80 and a light chain variable region comprising an amino acid sequence of SEQ ID NO:81, (h) the moiety capable of specific binding to 4-1BB comprises a heavy chain variable region VH comprising an amino acid sequence of SEQ ID NO:64 and a light chain variable region comprising an amino acid sequence of SEQ ID NO:65 and the moiety capable of specific binding to FAP comprises a heavy chain variable region VH comprising an amino acid sequence of SEQ ID NO:82 and a light chain variable region comprising an amino acid sequence of SEQ ID NO:83, (i) the moiety capable of specific binding to 4-1BB comprises a heavy chain variable region VH comprising an amino acid sequence of SEQ ID NO:66 and a light chain variable region comprising an amino acid sequence of SEQ ID NO:67 and the moiety capable of specific binding to FAP comprises a heavy chain variable region VH comprising an amino acid sequence of SEQ ID NO:80 and a light chain variable region comprising an amino acid sequence of SEQ ID NO:81, or (j) the moiety capable of specific binding to 4-1BB comprises a heavy chain variable region VH comprising an amino acid sequence of SEQ ID NO:66 and a light chain variable region comprising an amino acid sequence of SEQ ID NO:67 and the moiety capable of specific binding to FAP comprises a heavy chain variable region VH comprising an amino acid sequence of SEQ ID NO:82 and a light chain variable region comprising an amino acid sequence of SEQ ID NO:83.

Bispecific, Monovalent Antigen Binding Molecules (1+1 Format)

In one aspect, the invention relates to bispecific antigen binding molecules comprising (a) one moiety capable of specific binding to a costimulatory TNF receptor family member, (b) one moiety capable of specific binding to a target cell antigen, and (c) a Fc domain composed of a first and a second subunit capable of stable association.

In a particular aspect, provided is a bispecific antigen binding molecule, wherein said molecule comprises
(a) a first Fab fragment capable of specific binding to a costimulatory TNF receptor family member,
(b) a second Fab fragment capable of specific binding to a target cell antigen, and
(c) a Fc domain composed of a first and a second subunit capable of stable association.

In one aspect, provided is a bispecific antigen binding molecule, wherein said molecule comprises
(a) a first Fab fragment capable of specific binding to OX40,
(b) a second Fab fragment capable of specific binding to a target cell antigen, and
(c) a Fc domain composed of a first and a second subunit capable of stable association.

In a further aspect, provided is a bispecific antigen binding molecule, wherein said molecule comprises
(a) a first Fab fragment capable of specific binding to OX40,
(b) a second Fab fragment capable of specific binding to FAP, and
(c) a Fc domain composed of a first and a second subunit capable of stable association.

In a particular aspect, the invention provides a bispecific antigen binding molecule comprising
(a) a first heavy chain comprising the amino acid sequence of SEQ ID NO:303, a first light chain comprising the amino acid sequence of SEQ ID NO:182, a second heavy chain comprising the amino acid sequence of SEQ ID NO:229, and a second light chain comprising the amino acid sequence of SEQ ID NO:217, or
(b) a first heavy chain comprising the amino acid sequence of SEQ ID NO:231, a first light chain comprising the amino acid sequence of SEQ ID NO: 186, a second heavy chain comprising the amino acid sequence of SEQ ID NO:229, and a second light chain comprising the amino acid sequence of SEQ ID NO:217, or
(c) a first heavy chain comprising the amino acid sequence of SEQ ID NO:233, a first light chain comprising the amino acid sequence of SEQ ID NO:190, a second heavy chain comprising the amino acid sequence of SEQ ID NO:229, and a second light chain comprising the amino acid sequence of SEQ ID NO:217, or
(d) a first heavy chain comprising the amino acid sequence of SEQ ID NO:235, a first light chain comprising the amino acid sequence of SEQ ID NO:194, a second heavy chain comprising the amino acid sequence of SEQ ID NO:229, and a second light chain comprising the amino acid sequence of SEQ ID NO:217, or
(e) a first heavy chain comprising the amino acid sequence of SEQ ID NO: 237, a first light chain comprising the amino acid sequence of SEQ ID NO:198, a second heavy chain comprising the amino acid sequence of SEQ ID NO:229, and a second light chain comprising the amino acid sequence of SEQ ID NO:217, or
(f) a first heavy chain comprising the amino acid sequence of SEQ ID NO:239, a first light chain comprising the amino acid sequence of SEQ ID NO:202, a second heavy chain comprising the amino acid sequence of SEQ ID NO:229, and a second light chain comprising the amino acid sequence of SEQ ID NO:217.

In one aspect, provided is a bispecific antigen binding molecule, wherein said molecule comprises
(a) a first Fab fragment capable of specific binding to 4-1BB,
(b) a second Fab fragment capable of specific binding to a target cell antigen, and
(c) a Fc domain composed of a first and a second subunit capable of stable association.

In a further aspect, provided is a bispecific antigen binding molecule, wherein said molecule comprises
(a) a first Fab fragment capable of specific binding to 4-1BB,
(b) a second Fab fragment capable of specific binding to FAP, and
(c) a Fc domain composed of a first and a second subunit capable of stable association.

In a particular aspect, the invention provides a bispecific antigen binding molecule comprising
(a) a first heavy chain comprising the amino acid sequence of SEQ ID NO:295, a first light chain comprising the amino acid sequence of SEQ ID NO:261, a second heavy chain comprising the amino acid sequence of SEQ ID NO:229, and a second light chain comprising the amino acid sequence of SEQ ID NO:217, or
(b) a first heavy chain comprising the amino acid sequence of SEQ ID NO:297, a first light chain comprising the amino acid sequence of SEQ ID NO:265, a second heavy chain comprising the amino acid sequence of SEQ ID NO:229, and a second light chain comprising the amino acid sequence of SEQ ID NO:217, or
(c) a first heavy chain comprising the amino acid sequence of SEQ ID NO:299, a first light chain comprising the amino acid sequence of SEQ ID NO:269, a second heavy chain comprising the amino acid sequence of SEQ ID NO:229, and a second light chain comprising the amino acid sequence of SEQ ID NO:217, or
(d) a first heavy chain comprising the amino acid sequence of SEQ ID NO:301, a first light chain comprising the amino acid sequence of SEQ ID NO:273, a second heavy chain comprising the amino acid sequence of SEQ ID NO:229, and a second light chain comprising the amino acid sequence of SEQ ID NO:217.

Bispecific, Bivalent Antigen Binding Molecules (2+2 Format)

In another aspect, the invention relates to a bispecific antigen binding molecule, comprising
(a) two moieties capable of specific binding to a costimulatory TNF receptor family member,
(b) two moieties capable of specific binding to a target cell antigen, and
(c) a Fc domain composed of a first and a second subunit capable of stable association.

In one aspect, the bispecific antigen binding molecule is bivalent both for the costimulatory TNF receptor family member and for the target cell antigen.

In one aspect, the bispecific antigen binding molecule of the invention comprises
(a) two light chains and two heavy chains of an antibody comprising two Fab fragments capable of specific binding to a costimulatory TNF receptor family member and the Fc domain, and
(b) two additional Fab fragments capable of specific binding to a target cell antigen, wherein said additional Fab fragments are each connected via a peptide linker to the C-terminus of the heavy chains of (a).

In a particular aspect, the peptide linker is (G4S)$_4$.

In another aspect, the two additional Fab fragments capable of specific binding to a target cell antigen are crossover Fab fragments wherein the variable domains VL and VH are replaced by each other and the VL-CH chains are each connected via a peptide linker to the C-terminus of the heavy chains of (a).

In particular, the invention relates to bispecific antigen binding molecules, wherein the two Fab fragments capable of specific binding to a costimulatory TNF receptor family member are two Fab fragments capable of specific binding to OX40 or 4-1BB and the two additional Fab fragments capable of specific binding to a target cell antigen are crossover Fab fragments capable of specific binding to FAP.

In one aspect, the invention relates to a bispecific antigen binding molecule, comprising (a) two moieties capable of specific binding to OX40, (b) two moieties capable of specific binding to FAP, and (c) a Fc domain composed of a first and a second subunit capable of stable association.

In a particular aspect, the invention provides a bispecific antigen binding molecule comprising
(a) two heavy chains, each comprising the amino acid sequence of SEQ ID NO:216, a first light chain comprising the amino acid sequence of SEQ ID NO:182, and a second light chain comprising the amino acid sequence of SEQ ID NO:217, or
(b) two heavy chains, each comprising the amino acid sequence of SEQ ID NO:219, a first light chain comprising the amino acid sequence of SEQ ID NO:186, and a second light chain comprising the amino acid sequence of SEQ ID NO:217, or
(c) two heavy chains, each comprising the amino acid sequence of SEQ ID NO:221, a first light chain comprising the amino acid sequence of SEQ ID NO:190, and a second light chain comprising the amino acid sequence of SEQ ID NO:217, or
(d) two heavy chains, each comprising the amino acid sequence of SEQ ID NO:223, a first light chain comprising the amino acid sequence of SEQ ID NO:194, and a second light chain comprising the amino acid sequence of SEQ ID NO:217, or
(e) two heavy chains, each comprising the amino acid sequence of SEQ ID NO:225, a first light chain comprising the amino acid sequence of SEQ ID NO:198, and a second light chain comprising the amino acid sequence of SEQ ID NO:217, or
(f) two heavy chains, each comprising the amino acid sequence of SEQ ID NO:227, a first light chain comprising the amino acid sequence of SEQ ID NO:202, and a second light chain comprising the amino acid sequence of SEQ ID NO:217.

In one aspect, the invention relates to a bispecific antigen binding molecule, comprising (a) two moieties capable of specific binding to 4-1BB, (b) two moieties capable of specific binding to FAP, and (c) a Fc domain composed of a first and a second subunit capable of stable association.

In a particular aspect, the invention provides a bispecific antigen binding molecule comprising
(a) two heavy chains, each comprising the amino acid sequence of SEQ ID NO:287, a first light chain comprising the amino acid sequence of SEQ ID NO:261, and a second light chain comprising the amino acid sequence of SEQ ID NO:217, or
(b) two heavy chains, each comprising the amino acid sequence of SEQ ID NO:289, a first light chain comprising the amino acid sequence of SEQ ID NO:265, and a second light chain comprising the amino acid sequence of SEQ ID NO:217, or
(c) two heavy chains, each comprising the amino acid sequence of SEQ ID NO:291, a first light chain comprising the amino acid sequence of SEQ ID NO:269, and a second light chain comprising the amino acid sequence of SEQ ID NO:217, or
(d) two heavy chains, each comprising the amino acid sequence of SEQ ID NO:293, a first light chain comprising the amino acid sequence of SEQ ID NO:273, and a second light chain comprising the amino acid sequence of SEQ ID NO:217.

Bispecific Antigen Binding Molecules Bivalent for Binding to a Costimulatory TNF Receptor Family Member and Monovalent for Binding to a Target Cell Antigen (2+1 Format)

In another aspect, the invention provides a bispecific antigen binding molecule comprising
(a) two moieties capable of specific binding to a costimulatory TNF receptor family member,
(b) one moiety capable of specific binding to a target cell antigen, and
(c) a Fc domain composed of a first and a second subunit capable of stable association.

Thus, provided is a bispecific antigen binding molecule, wherein the bispecific antigen binding molecule is bivalent for the costimulatory TNF receptor family member and monovalent for the target cell antigen.

In a particular aspect, the bispecific antigen binding molecule comprises
(a) two light chains and two heavy chains of an antibody comprising two Fab fragments capable of specific binding to a costimulatory TNF receptor family member and the Fc domain, and
(b) a VH and VL domain capable of specific binding to a target cell antigen, wherein the VH domain is connected via a peptide linker to the C-terminus of one of the heavy chains and wherein the VL domain is connected via a peptide linker to the C-terminus of the second heavy chain.

In another particular aspect, the bispecific antigen binding molecule comprises
(a) two light chains and two heavy chains of an antibody comprising two Fab fragments capable of specific binding to a costimulatory TNF receptor family member and the Fc domain, and
(b) a VH and VL domain capable of specific binding to a target cell antigen, wherein the VH domain is connected via a peptide linker to the C-terminus of the Fc knob heavy chain and wherein the VL domain is connected via a peptide linker to the C-terminus of the Fc hole heavy chain.

In another particular aspect, the bispecific antigen binding molecule comprises
(a) two light chains and two heavy chains of an antibody comprising two Fab fragments capable of specific binding to a costimulatory TNF receptor family member and the Fc domain, and
(b) a VH and VL domain capable of specific binding to a target cell antigen, wherein the VH domain is connected via a peptide linker to the C-terminus of the Fc hole heavy chain and wherein the VL domain is connected via a peptide linker to the C-terminus of the Fc knob heavy chain. In particular, the invention relates to bispecific antigen binding molecules, wherein the two Fab fragments capable of specific binding to a costimulatory TNF receptor family member are two Fab fragments capable of specific binding to OX40 or 4-1BB and the VH and VL domain capable of specific binding to a target cell antigen are capable of specific binding to FAP.

In one aspect, the invention relates to a bispecific antigen binding molecule, comprising (a) two Fab fragments capable of specific binding to OX40, (b) a VH and a VL domain capable of specific binding to FAP, and (c) a Fc domain composed of a first and a second subunit capable of stable association.

In a particular aspect, the invention provides a bispecific antigen binding molecule comprising
(a) two light chains, each comprising the amino acid sequence of SEQ ID NO:186, a first heavy chain comprising the amino acid sequence of SEQ ID NO:306, and a second heavy chain comprising the amino acid sequence of SEQ ID NO:307, or
(b) two light chains, each comprising the amino acid sequence of SEQ ID NO:186, a first heavy chain comprising the amino acid sequence of SEQ ID NO:310, and a second heavy chain comprising the amino acid sequence of SEQ ID NO:311.

In one aspect, the invention relates to a bispecific antigen binding molecule, comprising (a) two Fab fragments capable of specific binding to 4-1BB, (b) a VH and a VL domain capable of specific binding to FAP, and (c) a Fc domain composed of a first and a second subunit capable of stable association.

In a particular aspect, the invention provides a bispecific antigen binding molecule comprising
(a) two light chains, each comprising the amino acid sequence of SEQ ID NO:261, a first heavy chain comprising the amino acid sequence of SEQ ID NO:318, and a second heavy chain comprising the amino acid sequence of SEQ ID NO:319, or
(b) two light chains, each comprising the amino acid sequence of SEQ ID NO:265, a first heavy chain comprising the amino acid sequence of SEQ ID NO:322, and a second heavy chain comprising the amino acid sequence of SEQ ID NO:323, or
(c) two light chains, each comprising the amino acid sequence of SEQ ID NO:269, a first heavy chain comprising the amino acid sequence of SEQ ID NO:326, and a second heavy chain comprising the amino acid sequence of SEQ ID NO:327, or
(d) two light chains, each comprising the amino acid sequence of SEQ ID NO:273, a first heavy chain comprising the amino acid sequence of SEQ ID NO:330, and a second heavy chain comprising the amino acid sequence of SEQ ID NO:331, or
(e) two light chains, each comprising the amino acid sequence of SEQ ID NO:261, a first heavy chain comprising the amino acid sequence of SEQ ID NO:334, and a second heavy chain comprising the amino acid sequence of SEQ ID NO:335, or
(f) two light chains, each comprising the amino acid sequence of SEQ ID NO:265, a first heavy chain comprising the amino acid sequence of SEQ ID NO:338, and a second heavy chain comprising the amino acid sequence of SEQ ID NO:339, or
(g) two light chains, each comprising the amino acid sequence of SEQ ID NO:269, a first heavy chain comprising the amino acid sequence of SEQ ID NO:342, and a second heavy chain comprising the amino acid sequence of SEQ ID NO:343, or
(h) two light chains, each comprising the amino acid sequence of SEQ ID NO:273, a first heavy chain comprising the amino acid sequence of SEQ ID NO:346, and a second heavy chain comprising the amino acid sequence of SEQ ID NO:347.

Fc Domain Modifications Reducing Fc Receptor Binding and/or Effector Function

The bispecific antigen binding molecules of the invention further comprise a Fc domain composed of a first and a second subunit capable of stable association.

In certain aspects, one or more amino acid modifications may be introduced into the Fc region of an antibody provided herein, thereby generating an Fc region variant. The Fc region variant may comprise a human Fc region sequence (e.g., a human IgG1, IgG2, IgG3 or IgG4 Fc region) comprising an amino acid modification (e.g. a substitution) at one or more amino acid positions.

The Fc domain confers favorable pharmacokinetic properties to the bispecific antibodies of the invention, including a long serum half-life which contributes to good accumulation in the target tissue and a favorable tissue-blood distribution ratio. At the same time it may, however, lead to undesirable targeting of the bispecific antibodies of the invention to cells expressing Fc receptors rather than to the preferred antigen-bearing cells. Accordingly, in particular embodiments the Fc domain of the bispecific antibodies of the invention exhibits reduced binding affinity to an Fc receptor and/or reduced effector function, as compared to a native IgG Fc domain, in particular an IgG1 Fc domain or an IgG4 Fc domain. More particularly, the Fc domain is an IgG1 Fc domain.

In one such aspect the Fc domain (or the bispecific antigen binding molecule of the invention comprising said Fc domain) exhibits less than 50%, preferably less than 20%, more preferably less than 10% and most preferably less than 5% of the binding affinity to an Fc receptor, as compared to a native IgG1 Fc domain (or the bispecific antigen binding molecule of the invention comprising a native IgG1 Fc domain), and/or less than 50%, preferably less than 20%, more preferably less than 10% and most preferably less than 5% of the effector function, as compared to a native IgG1 Fc domain (or the bispecific antigen binding molecule of the invention comprising a native IgG1 Fc domain). In one aspect, the Fc domain (or the bispecific antigen binding molecule of the invention comprising said Fc domain) does not substantially bind to an Fc receptor and/or induce effector function. In a particular aspect the Fc receptor is an Fcγ receptor. In one aspect, the Fc receptor is a human Fc receptor. In one aspect, the Fc receptor is an activating Fc receptor. In a specific aspect, the Fc receptor is an activating human Fcγ receptor, more specifically human FcγRIIIa, FcγRI or FcγRIIa, most specifically human FcγRIIIa. In one aspect, the Fc receptor is an inhibitory Fc receptor. In a specific aspect, the Fc receptor is an inhibitory human Fcγ receptor, more specifically human FcγRIIB. In one aspect the effector function is one or more of CDC, ADCC, ADCP, and cytokine secretion. In a particular aspect, the effector function is ADCC. In one aspect, the Fc domain exhibits substantially similar binding affinity to neonatal Fc receptor (FcRn), as compared to a native IgG1 Fc domain. Substantially similar binding to FcRn is achieved when the Fc domain (or the bispecific antigen binding molecule of the invention comprising said Fc domain) exhibits greater than about 70%, particularly greater than about 80%, more particularly greater than about 90% of the binding affinity of a native IgG1 Fc domain (or the bispecific antigen binding molecule of the invention comprising a native IgG1 Fc domain) to FcRn.

In a particular aspect, the Fc domain is engineered to have reduced binding affinity to an Fc receptor and/or reduced effector function, as compared to a non-engineered Fc domain. In a particular aspect, the Fc domain of the bispecific antigen binding molecule of the invention comprises one or more amino acid mutation that reduces the binding affinity of the Fc domain to an Fc receptor and/or effector function. Typically, the same one or more amino acid mutation is present in each of the two subunits of the Fc domain. In one aspect, the amino acid mutation reduces the binding affinity of the Fc domain to an Fc receptor. In another aspect, the amino acid mutation reduces the binding affinity of the Fc domain to an Fc receptor by at least 2-fold, at least 5-fold, or at least 10-fold. In one aspect, the bispecific antigen binding molecule of the invention comprising an engineered Fc domain exhibits less than 20%, particularly less than 10%, more particularly less than 5% of the binding affinity to an Fc receptor as compared to bispecific antibodies of the invention comprising a non-engineered Fc domain. In a particular aspect, the Fc receptor is an Fcγ receptor. In other aspects, the Fc receptor is a human Fc receptor. In one aspect, the Fc receptor is an inhibitory Fc receptor. In a specific aspect, the Fc receptor is an inhibitory human Fcγ receptor, more specifically human FcγRIIB. In some aspects the Fc receptor is an activating Fc receptor. In a specific aspect, the Fc receptor is an activating human Fcγ receptor, more specifically human FcγRIIIa, FcγRI or FcγRIIa, most specifically human FcγRIIIa. Preferably, binding to each of these receptors is reduced. In some aspects, binding affinity to a complement component, specifically binding affinity to C1q, is also reduced. In one aspect, binding affinity to neonatal Fc receptor (FcRn) is not reduced. Substantially similar binding to FcRn, i.e. preservation of the binding affinity of the Fc domain to said receptor, is achieved when the Fc domain (or the bispecific antigen binding molecule of the invention comprising said Fc domain) exhibits greater than about 70% of the binding affinity of a non-engineered form of the Fc domain (or the bispecific antigen binding molecule of the invention comprising said non-engineered form of the Fc domain) to FcRn. The Fc domain, or the bispecific antigen binding molecule of the invention comprising said Fc domain, may exhibit greater than about 80% and even greater than about 90% of such affinity. In certain embodiments the Fc domain of the bispecific antigen binding molecule of the invention is engineered to have reduced effector function, as compared to a non-engineered Fc domain. The reduced effector function can include, but is not limited to, one or more of the following: reduced complement dependent cytotoxicity (CDC), reduced antibody-dependent cell-mediated cytotoxicity (ADCC), reduced antibody-dependent cellular phagocytosis (ADCP), reduced cytokine secretion, reduced immune complex-mediated antigen uptake by antigen-presenting cells, reduced binding to NK cells, reduced binding to macrophages, reduced binding to monocytes, reduced binding to polymorphonuclear cells, reduced direct signaling inducing apoptosis, reduced dendritic cell maturation, or reduced T cell priming.

Antibodies with reduced effector function include those with substitution of one or more of Fc region residues 238, 265, 269, 270, 297, 327 and 329 (U.S. Pat. No. 6,737,056). Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. No. 7,332,581). Certain antibody variants with improved or diminished binding to FcRs are described. (e.g. U.S. Pat. No. 6,737,056; WO 2004/056312, and Shields, R. L. et al., J. Biol. Chem. 276 (2001) 6591-6604).

In one aspect of the invention, the Fc domain comprises an amino acid substitution at a position of E233, L234, L235, N297, P331 and P329. In some aspects, the Fc domain comprises the amino acid substitutions L234A and L235A ("LALA"). In one such embodiment, the Fc domain is an IgG1 Fc domain, particularly a human IgG1 Fc domain. In one aspect, the Fc domain comprises an amino acid substitution at position P329. In a more specific aspect, the amino acid substitution is P329A or P329G, particularly P329G. In one embodiment the Fc domain comprises an amino acid substitution at position P329 and a further amino acid substitution selected from the group consisting of E233P, L234A, L235A, L235E, N297A, N297D or P331S. In more particular embodiments the Fc domain comprises the amino acid mutations L234A, L235A and P329G ("P329G LALA"). The "P329G LALA" combination of amino acid substitutions almost completely abolishes Fcγ receptor binding of a human IgG1 Fc domain, as described in PCT Patent Application No. WO 2012/130831 A1. Said document also describes methods of preparing such mutant Fc domains and methods for determining its properties such as Fc receptor binding or effector functions. such antibody is an IgG1 with mutations L234A and L235A or with mutations L234A, L235A and P329G (numbering according to EU index of Kabat et al, Kabat et al., Sequences of Proteins of Immunological Interest, 5th Ed. Public Health Service, National Institutes of Health, Bethesda, Md., 1991).

In one aspect, the Fc domain is an IgG4 Fc domain. In a more specific embodiment, the Fc domain is an IgG4 Fc domain comprising an amino acid substitution at position 5228 (Kabat numbering), particularly the amino acid substitution S228P. In a more specific embodiment, the Fc domain is an IgG4 Fc domain comprising amino acid substitutions L235E and S228P and P329G. This amino acid substitution reduces in vivo Fab arm exchange of IgG4 antibodies (see Stubenrauch et al., Drug Metabolism and Disposition 38, 84-91 (2010)).

Antibodies with increased half lives and improved binding to the neonatal Fc receptor (FcRn), which is responsible for the transfer of maternal IgGs to the fetus (Guyer, R. L. et al., J. Immunol. 117 (1976) 587-593, and Kim, J. K. et al., J. Immunol. 24 (1994) 2429-2434), are described in US 2005/0014934. Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434, e.g., substitution of Fc region residue 434 (U.S. Pat. No. 7,371,826). See also Duncan, A. R. and Winter, G., Nature 322 (1988) 738-740; U.S. Pat. Nos. 5,648,260; 5,624,821; and WO 94/29351 concerning other examples of Fc region variants.

Binding to Fc receptors can be easily determined e.g. by ELISA, or by Surface Plasmon Resonance (SPR) using standard instrumentation such as a BIAcore instrument (GE Healthcare), and Fc receptors such as may be obtained by recombinant expression. A suitable such binding assay is described herein. Alternatively, binding affinity of Fc domains or cell activating bispecific antigen binding molecules comprising an Fc domain for Fc receptors may be evaluated using cell lines known to express particular Fc receptors, such as human NK cells expressing FcγIIIa receptor. Effector function of an Fc domain, or bispecific antibodies of the invention comprising an Fc domain, can be measured by methods known in the art. A suitable assay for measuring ADCC is described herein. Other examples of in vitro assays to assess ADCC activity of a molecule of interest are described in U.S. Pat. No. 5,500,362; Hellstrom et al. Proc Natl Acad Sci USA 83, 7059-7063 (1986) and Hellstrom et al., Proc Natl Acad Sci USA 82, 1499-1502 (1985); U.S. Pat. No. 5,821,337; Bruggemann et al., J Exp Med 166, 1351-1361 (1987). Alternatively, non-radioactive assays methods may be employed (see, for example, ACTI™ non-radioactive cytotoxicity assay for flow cytometry (CellTechnology, Inc. Mountain View, Calif.); and CytoTox 96® non-radioactive cytotoxicity assay (Promega, Madison, Wis.)). Useful effector cells for such assays include peripheral blood mononuclear cells (PBMC) and Natural Killer (NK) cells. Alternatively, or additionally, ADCC activity of the molecule of interest may be assessed in vivo, e.g. in a animal model such as that disclosed in Clynes et al., Proc Natl Acad Sci USA 95, 652-656 (1998).

The following section describes preferred aspects of the bispecific antigen binding molecules of the invention comprising Fc domain modifications reducing Fc receptor binding and/or effector function. In one aspect, the invention relates to the bispecific antigen binding molecule (a) at least one moiety capable of specific binding to a costimulatory TNF receptor family member, (b) at least one moiety capable of specific binding to a target cell antigen, and (c) a Fc domain composed of a first and a second subunit capable of stable association, wherein the Fc domain comprises one or more amino acid substitution that reduces the binding affinity of the antibody to an Fc receptor, in particular towards Fcγ receptor. In another aspect, the invention relates to the bispecific antigen binding molecule comprising (a) at least one moiety capable of specific binding to a costimulatory TNF receptor family member, (b) at least one moiety capable of specific binding to a target cell antigen, and (c) a Fc domain composed of a first and a second subunit capable of stable association, wherein the Fc domain comprises one or more amino acid substitution that reduces effector function. In particular aspect, the Fc domain is of human IgG1 subclass with the amino acid mutations L234A, L235A and P329G (numbering according to Kabat EU index).

Fc Domain Modifications Promoting Heterodimerization

The bispecific antigen binding molecules of the invention comprise different antigen-binding sites, fused to one or the other of the two subunits of the Fc domain, thus the two subunits of the Fc domain may be comprised in two non-identical polypeptide chains. Recombinant co-expression of these polypeptides and subsequent dimerization leads to several possible combinations of the two polypeptides. To improve the yield and purity of the bispecific antibodies of the invention in recombinant production, it will thus be advantageous to introduce in the Fc domain of the bispecific antigen binding molecules of the invention a modification promoting the association of the desired polypeptides.

Accordingly, in particular aspects the invention relates to the bispecific antigen binding molecule comprising (a) at least one moiety capable of specific binding to a costimulatory TNF receptor family member, (b) at least one moiety capable of specific binding to a target cell antigen, and (c) a Fc domain composed of a first and a second subunit capable of stable association, wherein the Fc domain comprises a modification promoting the association of the first and second subunit of the Fc domain. The site of most extensive protein-protein interaction between the two subunits of a human IgG Fc domain is in the CH3 domain of the Fc domain. Thus, in one aspect said modification is in the CH3 domain of the Fc domain.

In a specific aspect said modification is a so-called "knob-into-hole" modification, comprising a "knob" modification in one of the two subunits of the Fc domain and a "hole" modification in the other one of the two subunits of the Fc domain. Thus, the invention relates to the bispecific antigen binding molecule comprising (a) at least one moiety capable of specific binding to a costimulatory TNF receptor family member, (b) at least one moiety capable of specific binding to a target cell antigen, and (c) a Fc domain composed of a first and a second subunit capable of stable association, wherein the first subunit of the Fc domain comprises knobs and the second subunit of the Fc domain comprises holes according to the knobs into holes method. In a particular aspect, the first subunit of the Fc domain comprises the amino acid substitutions S354C and T366W (EU numbering) and the second subunit of the Fc domain comprises the amino acid substitutions Y349C, T366S and Y407V (numbering according to Kabat EU index).

The knob-into-hole technology is described e.g. in U.S. Pat. Nos. 5,731,168; 7,695,936; Ridgway et al., Prot Eng 9, 617-621 (1996) and Carter, J Immunol Meth 248, 7-15 (2001). Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g. tyrosine or tryptophan). Compensatory cavities of identical or similar size to the protuberances are created in the interface of the second polypeptide by replacing large amino acid side chains with smaller ones (e.g. alanine or threonine).

Accordingly, in one aspect, in the CH3 domain of the first subunit of the Fc domain of the bispecific antigen binding molecules of the invention an amino acid residue is replaced with an amino acid residue having a larger side chain volume, thereby generating a protuberance within the CH3 domain of the first subunit which is positionable in a cavity within the CH3 domain of the second subunit, and in the CH3 domain of the second subunit of the Fc domain an amino acid residue is replaced with an amino acid residue having a smaller side chain volume, thereby generating a cavity within the CH3 domain of the second subunit within which the protuberance within the CH3 domain of the first subunit is positionable. The protuberance and cavity can be made by altering the nucleic acid encoding the polypeptides, e.g. by site-specific mutagenesis, or by peptide synthesis. In a specific aspect, in the CH3 domain of the first subunit of the Fc domain the threonine residue at position 366 is replaced with a tryptophan residue (T366W), and in the CH3 domain of the second subunit of the Fc domain the tyrosine residue at position 407 is replaced with a valine residue (Y407V). In one aspect, in the second subunit of the Fc domain additionally the threonine residue at position 366 is replaced with a serine residue (T366S) and the leucine residue at position 368 is replaced with an alanine residue (L368A).

In yet a further aspect, in the first subunit of the Fc domain additionally the serine residue at position 354 is replaced with a cysteine residue (S354C), and in the second subunit of the Fc domain additionally the tyrosine residue at position 349 is replaced by a cysteine residue (Y349C). Introduction of these two cysteine residues results in formation of a disulfide bridge between the two subunits of the Fc domain, further stabilizing the dimer (Carter (2001), J Immunol Methods 248, 7-15). In a particular aspect, the first subunit of the Fc domain comprises the amino acid substitutions S354C and T366W (EU numbering) and the second subunit of the Fc domain comprises the amino acid substitutions Y349C, T366S and Y407V (numbering according to Kabat EU index).

In an alternative aspect, a modification promoting association of the first and the second subunit of the Fc domain comprises a modification mediating electrostatic steering effects, e.g. as described in PCT publication WO 2009/089004. Generally, this method involves replacement of one or more amino acid residues at the interface of the two Fc domain subunits by charged amino acid residues so that homodimer formation becomes electrostatically unfavorable but heterodimerization electrostatically favorable.

The C-terminus of the heavy chain of the bispecific antibody as reported herein can be a complete C-terminus ending with the amino acid residues PGK. The C-terminus of the heavy chain can be a shortened C-terminus in which one or two of the C terminal amino acid residues have been removed. In one preferred aspect, the C-terminus of the heavy chain is a shortened C-terminus ending PG. In one aspect of all aspects as reported herein, a bispecific antibody comprising a heavy chain including a C-terminal CH3 domain as specified herein, comprises the C-terminal glycine-lysine dipeptide (G446 and K447, numbering according to Kabat EU index). In one embodiment of all aspects as reported herein, a bispecific antibody comprising a heavy chain including a C-terminal CH3 domain, as specified herein, comprises a C-terminal glycine residue (G446, numbering according to Kabat EU index).

Modifications in the Fab Domains

In one aspect, the invention relates to a bispecific antigen binding molecule comprising (a) a first Fab fragment capable of specific binding to a costimulatory TNF receptor family member, (b) a second Fab fragment capable of specific binding to a target cell antigen, and (c) a Fc domain composed of a first and a second subunit capable of stable association, wherein in one of the Fab fragments either the variable domains VH and VL or the constant domains CH1 and CL are exchanged. The bispecific antibodies are prepared according to the Crossmab technology.

Multispecific antibodies with a domain replacement/exchange in one binding arm (CrossMabVH-VL or CrossMabCH-CL) are described in detail in WO2009/080252 and Schaefer, W. et al, PNAS, 108 (2011) 11187-1191. They clearly reduce the byproducts caused by the mismatch of a light chain against a first antigen with the wrong heavy chain against the second antigen (compared to approaches without such domain exchange).

In one aspect, the invention relates to a bispecific antigen binding molecule comprising (a) a first Fab fragment capable of specific binding to a costimulatory TNF receptor family member, (b) a second Fab fragment capable of specific binding to a target cell antigen, and (c) a Fc domain composed of a first and a second subunit capable of stable association, wherein in one of the Fab fragments the constant domains CL and CH1 are replaced by each other so that the CH1 domain is part of the light chain and the CL domain is part of the heavy chain. More particularly, in the second Fab fragment capable of specific binding to a target cell antigen the constant domains CL and CH1 are replaced by each other so that the CH1 domain is part of the light chain and the CL domain is part of the heavy chain.

In a particular aspect, the invention relates a bispecific antigen binding molecule comprising (a) a first Fab fragment capable of specific binding to a costimulatory TNF receptor family member, (b) a second Fab fragment capable of specific binding to a target cell antigen, wherein the constant domains CL and CH1 are replaced by each other so that the CH1 domain is part of the light chain and the CL domain is part of the heavy chain. Such a molecule is called a monvalent bispecific antigen binding molecule.

In another aspect, the invention relates to a bispecific antigen binding molecule, comprising (a) two light chains and two heavy chains of an antibody comprising two Fab fragments capable of specific binding to a costimulatory TNF receptor family member and the Fc domain, and (b) two additional Fab fragments capable of specific binding to a target cell antigen, wherein said additional Fab fragments are each connected via a peptide linker to the C-terminus of the heavy chains of (a). In a particular aspect, the additional Fab fragments are Fab fragments, wherein the variable domains VL and VH are replaced by each other so that the VH domain is part of the light chain and the VL domain is part of the heavy chain.

Thus, in a particular aspect, the invention comprises a bispecific, antigen binding molecule, comprising (a) two light chains and two heavy chains of an antibody comprising two Fab fragments capable of specific binding to a costimulatory TNF receptor family member and the Fc domain, and (b) two additional Fab fragments capable of specific binding to a target cell antigen, wherein said two additional Fab fragments capable of specific binding to a target cell antigen are crossover Fab fragments wherein the variable domains VL and VH are replaced by each other and the VL-CH chains are each connected via a peptide linker to the C-terminus of the heavy chains of (a).

In another aspect, and to further improve correct pairing, the bispecific antigen binding molecule comprising (a) a first Fab fragment capable of specific binding to a costimulatory TNF receptor family member, (b) a second Fab fragment capable of specific binding to a target cell antigen, and (c) a Fc domain composed of a first and a second subunit capable of stable association, can contain different charged amino acid substitutions (so-called "charged residues"). These modifications are introduced in the crossed or non-crossed CH1 and CL domains. In a particular aspect, the invention relates to a bispecific antigen binding molecule, wherein in one of CL domains the amino acid at position 123 (EU numbering) has been replaced by arginine (R) and the amino acid at position 124 (EU numbering) has been substituted by lysine (K) and wherein in one of the CH1 domains the amino acids at position 147 (EU numbering) and at position 213 (EU numbering) have been substituted by glutamic acid (E).

More particularly, the invention relates to a bispecific binding molecule comprising a Fab, wherein in the CL domain adjacent to the TNF ligand family member the amino acid at position 123 (EU numbering) has been replaced by arginine (R) and the amino acid at position 124 (EU numbering) has been substituted by lysine (K), and wherein in the CH1 domain adjacent to the TNF ligand family member the amino acids at position 147 (EU numbering) and at position 213 (EU numbering) have been substituted by glutamic acid (E).

Exemplary Antibodies of the Invention

In one aspect, the invention provides new antibodies and antibody fragments that specifically bind to OX40. These antibodies have superior properties compared to known OX40 antibodies that make them especially suitable for the incorporation into bispecific antigen binding molecules comprising another antigen binding moiety capable of specific binding to a target cell antigen.

In particular, provided is an antibody that specifically binds to OX40, wherein said antibody comprises (a) a VH domain comprising CDR-H1 comprising the amino acid sequence of SEQ ID NO:2, CDR-H2 comprising the amino acid sequence of SEQ ID NO:4, CDR-H3 comprising the amino acid sequence of SEQ ID NO:6 and a VL domain comprising CDR-L1 comprising the amino acid sequence of SEQ ID NO:13, CDR-H2 comprising the amino acid sequence of SEQ ID NO:16 and CDR-H3 comprising the amino acid sequence of SEQ ID NO:19, (b) a VH domain comprising CDR-H1 comprising the amino acid sequence of SEQ ID NO:2, CDR-H2 comprising the amino acid sequence of SEQ ID NO:4, CDR-H3 comprising the amino acid sequence of SEQ ID NO:7 and a VL domain comprising CDR-L1 comprising the amino acid sequence of SEQ ID NO:13, CDR-H2 comprising the amino acid sequence of SEQ ID NO:16 and CDR-H3 comprising the amino acid sequence of SEQ ID NO:20, (c) a VH domain comprising CDR-H1 comprising the amino acid sequence of SEQ ID NO:2, CDR-H2 comprising the amino acid sequence of SEQ ID NO:4, CDR-H3 comprising the amino acid sequence of SEQ ID NO:8 and a VL domain comprising CDR-L1 comprising the amino acid sequence of SEQ ID NO:13, CDR-H2 comprising the amino acid sequence of SEQ ID NO:16 and CDR-H3 comprising the amino acid sequence of SEQ ID NO:21, (d) a VH domain comprising CDR-H1 comprising the amino acid sequence of SEQ ID NO:2, CDR-H2 comprising the amino acid sequence of SEQ ID NO:4, CDR-H3 comprising the amino acid sequence of SEQ ID NO:9 and a VL domain comprising CDR-L1 comprising the amino acid sequence of SEQ ID NO:13, CDR-H2 comprising the amino acid sequence of SEQ ID NO:16 and CDR-H3 comprising the amino acid sequence of SEQ ID NO:22, (e) a VH domain comprising CDR-H1 comprising the amino acid sequence of SEQ ID NO:3, CDR-H2 comprising the amino acid sequence of SEQ ID NO:5, CDR-H3 comprising the amino acid sequence of SEQ ID NO:10 and a VL domain comprising CDR-L1 comprising the amino acid sequence of SEQ ID NO:14, CDR-H2 comprising the amino acid sequence of SEQ ID NO:17 and CDR-H3 comprising the amino acid sequence of SEQ ID NO:23, (f) a VH domain comprising CDR-H1 comprising the amino acid sequence of SEQ ID NO:3, CDR-H2 comprising the amino acid sequence of SEQ ID NO:5, CDR-H3 comprising the amino acid sequence of SEQ ID NO:11 and a VL domain comprising CDR-L1 comprising the amino acid sequence of SEQ ID NO:14, CDR-H2 comprising the amino acid sequence of SEQ ID NO:17 and CDR-H3 comprising the amino acid sequence of SEQ ID NO:23, or (g) a VH domain comprising CDR-H1 comprising the amino acid sequence of SEQ ID NO:3, CDR-H2 comprising the amino acid sequence of SEQ ID NO:5, CDR-H3 comprising the amino acid sequence of SEQ ID NO:12 and a VL domain comprising CDR-L1 comprising the amino acid sequence of SEQ ID NO:15, CDR-H2 comprising the amino acid sequence of SEQ ID NO:18 and CDR-H3 comprising the amino acid sequence of SEQ ID NO:24.

In one aspect, provided is an antibody that specifically binds to OX40, wherein said antibody comprises (i) a heavy chain variable region VH comprising an amino acid sequence of SEQ ID NO:25 and and a light chain variable region VL comprising an amino acid sequence of SEQ ID NO:26, (ii) a heavy chain variable region VH comprising an amino acid sequence of SEQ ID NO:27 and and a light chain variable region VL comprising an amino acid sequence of SEQ ID NO:28, (iii) a heavy chain variable region VH comprising an amino acid sequence of SEQ ID NO:29 and and a light chain variable region VL comprising an amino acid sequence of SEQ ID NO:30, (iv) a heavy chain variable region VH comprising an amino acid sequence of SEQ ID NO:31 and and a light chain variable region VL comprising an amino acid sequence of SEQ ID NO:32, (v) a heavy chain variable region VH comprising an amino acid sequence of SEQ ID NO:33 and and a light chain variable region VL comprising an amino acid sequence of SEQ ID NO:34, (vi) a heavy chain variable region VH comprising an amino acid sequence of SEQ ID NO:35 and and a light chain variable region VL comprising an amino acid sequence of SEQ ID NO:36, or (vii) a heavy chain variable region VH comprising an amino acid sequence of SEQ ID NO:37 and and a light chain variable region VL comprising an amino acid sequence of SEQ ID NO:38.

In a further aspect, provided is an antibody that competes for binding with an antibody that specifically binds to OX40, wherein said antibody comprises (i) a heavy chain variable region VH comprising an amino acid sequence of SEQ ID NO:25 and and a light chain variable region VL comprising an amino acid sequence of SEQ ID NO:26, (ii) a heavy chain variable region VH comprising an amino acid sequence of SEQ ID NO:27 and and a light chain variable region VL comprising an amino acid sequence of SEQ ID NO:28,
(iii) a heavy chain variable region VH comprising an amino acid sequence of SEQ ID NO:29 and and a light chain variable region VL comprising an amino acid sequence of SEQ ID NO:30,
(iv) a heavy chain variable region VH comprising an amino acid sequence of SEQ ID NO:31 and and a light chain variable region VL comprising an amino acid sequence of SEQ ID NO:32,
(v) a heavy chain variable region VH comprising an amino acid sequence of SEQ ID NO:33 and and a light chain variable region VL comprising an amino acid sequence of SEQ ID NO:34,
(vi) a heavy chain variable region VH comprising an amino acid sequence of SEQ ID NO:35 and and a light chain variable region VL comprising an amino acid sequence of SEQ ID NO:36, or
(vii) a heavy chain variable region VH comprising an amino acid sequence of SEQ ID NO:37 and and a light chain variable region VL comprising an amino acid sequence of SEQ ID NO:38.

In one aspect, provided is an antibody that competes for binding with an antibody that specifically binds to OX40, wherein said antibody comprises a heavy chain variable region VH comprising an amino acid sequence of SEQ ID NO:27 and a light chain variable region VL comprising an amino acid sequence of SEQ ID NO:28. In particular, provided is an antibody that specifically binds to OX40, wherein said antibody comprises a heavy chain variable region VH comprising an amino acid sequence of SEQ ID NO:27 and a light chain variable region VL comprising an amino acid sequence of SEQ ID NO:28.

In a further aspect, provided is an antibody that specifically binds to OX40 and is cross-reactive for human and murine OX40, wherein said antibody comprises a heavy chain variable region VH comprising an amino acid sequence of SEQ ID NO:31 and a light chain variable region VL comprising an amino acid sequence of SEQ ID NO:32.

In another aspect, the invention provides new antibodies and antibody fragments that specifically bind to 4-1BB. These antibodies have superior properties compared to known 4-1BB antibodies so that they are especially suitable for the incorporation into bispecific antigen binding molecules comprising another antigen binding moiety capable of specific binding to a target cell antigen.

In particular, provided is an antibody that specifically binds to 4-1BB, wherein said antibody comprises
(a) a VH domain comprising CDR-H1 comprising the amino acid sequence of SEQ ID NO:40, CDR-H2 comprising the amino acid sequence of SEQ ID NO:42, CDR-H3 comprising the amino acid sequence of SEQ ID NO:44 and a VL domain comprising CDR-L1 comprising the amino acid sequence of SEQ ID NO:49, CDR-H2 comprising the amino acid sequence of SEQ ID NO:51 and CDR-H3 comprising the amino acid sequence of SEQ ID NO:53,
(b) a VH domain comprising CDR-H1 comprising the amino acid sequence of SEQ ID NO:41, CDR-H2 comprising the amino acid sequence of SEQ ID NO:43, CDR-H3 comprising the amino acid sequence of SEQ ID NO:45 and a VL domain comprising CDR-L1 comprising the amino acid sequence of SEQ ID NO:50, CDR-H2 comprising the amino acid sequence of SEQ ID NO:52 and CDR-H3 comprising the amino acid sequence of SEQ ID NO:54,
(c) a VH domain comprising CDR-H1 comprising the amino acid sequence of SEQ ID NO:40, CDR-H2 comprising the amino acid sequence of SEQ ID NO:42, CDR-H3 comprising the amino acid sequence of SEQ ID NO:46 and a VL domain comprising CDR-L1 comprising the amino acid sequence of SEQ ID NO:49, CDR-H2 comprising the amino acid sequence of SEQ ID NO:51 and CDR-H3 comprising the amino acid sequence of SEQ ID NO:55,
(d) a VH domain comprising CDR-H1 comprising the amino acid sequence of SEQ ID NO:40, CDR-H2 comprising the amino acid sequence of SEQ ID NO:42, CDR-H3 comprising the amino acid sequence of SEQ ID NO:47 and a VL domain comprising CDR-L1 comprising the amino acid sequence of SEQ ID NO:49, CDR-H2 comprising the amino acid sequence of SEQ ID NO:51 and CDR-H3 comprising the amino acid sequence of SEQ ID NO:56, or
(e) a VH domain comprising CDR-H1 comprising the amino acid sequence of SEQ ID NO:40, CDR-H2 comprising the amino acid sequence of SEQ ID NO:42, CDR-H3 comprising the amino acid sequence of SEQ ID NO:48 and a VL domain comprising CDR-L1 comprising the amino acid sequence of SEQ ID NO:49, CDR-H2 comprising the amino acid sequence of SEQ ID NO:51 and CDR-H3 comprising the amino acid sequence of SEQ ID NO:57.

In one aspect, the invention provides an antibody that specifically binds to 4-1BB, wherein said antibody comprises
(i) a heavy chain variable region VH comprising an amino acid sequence of SEQ ID NO:58 and and a light chain variable region VL comprising an amino acid sequence of SEQ ID NO:59,
(ii) a heavy chain variable region VH comprising an amino acid sequence of SEQ ID NO:60 and and a light chain variable region VL comprising an amino acid sequence of SEQ ID NO:61,
(iii) a heavy chain variable region VH comprising an amino acid sequence of SEQ ID NO:62 and and a light chain variable region VL comprising an amino acid sequence of SEQ ID NO:63,
(iv) a heavy chain variable region VH comprising an amino acid sequence of SEQ ID NO:64 and and a light chain variable region VL comprising an amino acid sequence of SEQ ID NO:65, or
(v) a heavy chain variable region VH comprising an amino acid sequence of SEQ ID NO:66 and and a light chain variable region VL comprising an amino acid sequence of SEQ ID NO:67.

In a further aspect, the invention provides an antibody that competes for binding with an antibody that specifically binds to 4-1BB, wherein said antibody comprises
(i) a heavy chain variable region VH comprising an amino acid sequence of SEQ ID NO:58 and and a light chain variable region VL comprising an amino acid sequence of SEQ ID NO:59,
(ii) a heavy chain variable region VH comprising an amino acid sequence of SEQ ID NO:60 and and a light chain variable region VL comprising an amino acid sequence of SEQ ID NO:61,
(iii) a heavy chain variable region VH comprising an amino acid sequence of SEQ ID NO:62 and and a light chain variable region VL comprising an amino acid sequence of SEQ ID NO:63,
(iv) a heavy chain variable region VH comprising an amino acid sequence of SEQ ID NO:64 and and a light chain variable region VL comprising an amino acid sequence of SEQ ID NO:65, or
(v) a heavy chain variable region VH comprising an amino acid sequence of SEQ ID NO:66 and a light chain variable region VL comprising an amino acid sequence of SEQ ID NO:67.

Polynucleotides

The invention further provides isolated polynucleotides encoding a bispecific antigen binding molecule as described herein or a fragment thereof.

The isolated polynucleotides encoding bispecific antibodies of the invention may be expressed as a single polynucleotide that encodes the entire antigen binding molecule or as multiple (e.g., two or more) polynucleotides that are co-expressed. Polypeptides encoded by polynucleotides that are co-expressed may associate through, e.g., disulfide bonds or other means to form a functional antigen binding molecule. For example, the light chain portion of an immunoglobulin may be encoded by a separate polynucleotide from the heavy chain portion of the immunoglobulin. When co-expressed, the heavy chain polypeptides will associate with the light chain polypeptides to form the immunoglobulin.

In some aspects, the isolated polynucleotide encodes a polypeptide comprised in the bispecific molecule according to the invention as described herein.

In one aspect, the present invention is directed to an isolated polynucleotide encoding a bispecific antigen binding molecule, comprising (a) at least one moiety capable of specific binding to OX40, (b) at least one moiety capable of specific binding to a target cell antigen, and (c) a Fc domain composed of a first and a second subunit capable of stable association.

In another aspect, provided is an isolated polynucleotide encoding a bispecific antigen binding molecule, comprising (a) at least one moiety capable of specific binding to 4-1BB, (b) at least one moiety capable of specific binding to a target cell antigen, and (c) a Fc domain composed of a first and a second subunit capable of stable association.

In a further aspect, the invention is directed to an isolated polynucleotide comprising a sequence that encodes an antibody or antibody fragment that specifically binds at OX40.

In another aspect, provided is an isolated polynucleotide encoding an isolated polynucleotide comprising a sequence that encodes an antibody or antibody fragment that specifically binds at 4-1BB.

In certain embodiments the polynucleotide or nucleic acid is DNA. In other embodiments, a polynucleotide of the present invention is RNA, for example, in the form of messenger RNA (mRNA). RNA of the present invention may be single stranded or double stranded.

Recombinant Methods

Bispecific antibodies of the invention may be obtained, for example, by solid-state peptide synthesis (e.g. Merrifield solid phase synthesis) or recombinant production. For recombinant production one or more polynucleotide encoding the bispecific antigen binding molecule or polypeptide fragments thereof, e.g., as described above, is isolated and inserted into one or more vectors for further cloning and/or expression in a host cell. Such polynucleotide may be readily isolated and sequenced using conventional procedures. In one aspect of the invention, a vector, preferably an expression vector, comprising one or more of the polynucleotides of the invention is provided. Methods which are well known to those skilled in the art can be used to construct expression vectors containing the coding sequence of the bispecific antigen binding molecule (fragment) along with appropriate transcriptional/translational control signals. These methods include in vitro recombinant DNA techniques, synthetic techniques and in vivo recombination/genetic recombination. See, for example, the techniques described in Maniatis et al., MOLECULAR CLONING: A LABORATORY MANUAL, Cold Spring Harbor Laboratory, N.Y. (1989); and Ausubel et al., CURRENT PROTOCOLS IN MOLECULAR BIOLOGY, Greene Publishing Associates and Wiley Interscience, N.Y. (1989). The expression vector can be part of a plasmid, virus, or may be a nucleic acid fragment. The expression vector includes an expression cassette into which the polynucleotide encoding the bispecific antigen binding molecule or polypeptide fragments thereof (i.e. the coding region) is cloned in operable association with a promoter and/or other transcription or translation control elements. As used herein, a "coding region" is a portion of nucleic acid which consists of codons translated into amino acids. Although a "stop codon" (TAG, TGA, or TAA) is not translated into an amino acid, it may be considered to be part of a coding region, if present, but any flanking sequences, for example promoters, ribosome binding sites, transcriptional terminators, introns, 5' and 3' untranslated regions, and the like, are not part of a coding region. Two or more coding regions can be present in a single polynucleotide construct, e.g. on a single vector, or in separate polynucleotide constructs, e.g. on separate (different) vectors. Furthermore, any vector may contain a single coding region, or may comprise two or more coding regions, e.g. a vector of the present invention may encode one or more polypeptides, which are post- or co-translationally separated into the final proteins via proteolytic cleavage. In addition, a vector, polynucleotide, or nucleic acid of the invention may encode heterologous coding regions, either fused or unfused to a polynucleotide encoding the bispecific antigen binding molecule of the invention or polypeptide fragments thereof, or variants or derivatives thereof. Heterologous coding regions include without limitation specialized elements or motifs, such as a secretory signal peptide or a heterologous functional domain. An operable association is when a coding region for a gene product, e.g. a polypeptide, is associated with one or more regulatory sequences in such a way as to place expression of the gene product under the influence or control of the regulatory sequence(s). Two DNA fragments (such as a polypeptide coding region and a promoter associated therewith) are "operably associated" if induction of promoter function results in the transcription of mRNA encoding the desired gene product and if the nature of the linkage between the two DNA fragments does not interfere with the ability of the expression regulatory sequences to direct the expression of the gene product or interfere with the ability of the DNA template to be transcribed. Thus, a promoter region would be operably associated with a nucleic acid encoding a polypeptide if the promoter was capable of effecting transcription of that nucleic acid. The promoter may be a cell-specific promoter that directs substantial transcription of the DNA only in predetermined cells. Other transcription control elements, besides a promoter, for example enhancers, operators, repressors, and transcription termination signals, can be operably associated with the polynucleotide to direct cell-specific transcription.

Suitable promoters and other transcription control regions are disclosed herein. A variety of transcription control regions are known to those skilled in the art. These include, without limitation, transcription control regions, which function in vertebrate cells, such as, but not limited to, promoter and enhancer segments from cytomegaloviruses (e.g. the immediate early promoter, in conjunction with intron-A), simian virus 40 (e.g. the early promoter), and retroviruses (such as, e.g. Rous sarcoma virus). Other transcription control regions include those derived from vertebrate genes such as actin, heat shock protein, bovine growth hormone and rabbit â-globin, as well as other sequences capable of controlling gene expression in eukaryotic cells.

Additional suitable transcription control regions include tissue-specific promoters and enhancers as well as inducible promoters (e.g. promoters inducible tetracyclins). Similarly, a variety of translation control elements are known to those of ordinary skill in the art. These include, but are not limited to ribosome binding sites, translation initiation and termination codons, and elements derived from viral systems (particularly an internal ribosome entry site, or IRES, also referred to as a CITE sequence). The expression cassette may also include other features such as an origin of replication, and/or chromosome integration elements such as retroviral long terminal repeats (LTRs), or adeno-associated viral (AAV) inverted terminal repeats (ITRs).

Polynucleotide and nucleic acid coding regions of the present invention may be associated with additional coding regions which encode secretory or signal peptides, which direct the secretion of a polypeptide encoded by a polynucleotide of the present invention. For example, if secretion of the bispecific antigen binding molecule or polypeptide fragments thereof is desired, DNA encoding a signal sequence may be placed upstream of the nucleic acid encoding the bispecific antigen binding molecule of the invention or polypeptide fragments thereof. According to the signal hypothesis, proteins secreted by mammalian cells have a signal peptide or secretory leader sequence which is cleaved from the mature protein once export of the growing protein chain across the rough endoplasmic reticulum has been initiated. Those of ordinary skill in the art are aware that polypeptides secreted by vertebrate cells generally have a signal peptide fused to the N-terminus of the polypeptide, which is cleaved from the translated polypeptide to produce a secreted or "mature" form of the polypeptide. In certain embodiments, the native signal peptide, e.g. an immunoglobulin heavy chain or light chain signal peptide is used, or a functional derivative of that sequence that retains the ability to direct the secretion of the polypeptide that is operably associated with it. Alternatively, a heterologous mammalian signal peptide, or a functional derivative thereof, may be used. For example, the wild-type leader sequence may be substituted with the leader sequence of human tissue plasminogen activator (TPA) or mouse β-glucuronidase.

DNA encoding a short protein sequence that could be used to facilitate later purification (e.g. a histidine tag) or assist in labeling the fusion protein may be included within or at the ends of the polynucleotide encoding a bispecific antigen binding molecule of the invention or polypeptide fragments thereof.

In a further aspect of the invention, a host cell comprising one or more polynucleotides of the invention is provided. In certain aspects, a host cell comprising one or more vectors of the invention is provided. The polynucleotides and vectors may incorporate any of the features, singly or in combination, described herein in relation to polynucleotides and vectors, respectively. In one aspect, a host cell comprises (e.g. has been transformed or transfected with) a vector comprising a polynucleotide that encodes (part of) a bispecific antigen binding molecule of the invention of the invention. As used herein, the term "host cell" refers to any kind of cellular system which can be engineered to generate the fusion proteins of the invention or fragments thereof. Host cells suitable for replicating and for supporting expression of antigen binding molecules are well known in the art. Such cells may be transfected or transduced as appropriate with the particular expression vector and large quantities of vector containing cells can be grown for seeding large scale fermenters to obtain sufficient quantities of the antigen binding molecule for clinical applications. Suitable host cells include prokaryotic microorganisms, such as E. coli, or various eukaryotic cells, such as Chinese hamster ovary cells (CHO), insect cells, or the like. For example, polypeptides may be produced in bacteria in particular when glycosylation is not needed. After expression, the polypeptide may be isolated from the bacterial cell paste in a soluble fraction and can be further purified. In addition to prokaryotes, eukaryotic microbes such as filamentous fungi or yeast are suitable cloning or expression hosts for polypeptide-encoding vectors, including fungi and yeast strains whose glycosylation pathways have been "humanized", resulting in the production of a polypeptide with a partially or fully human glycosylation pattern. See Gerngross, Nat Biotech 22, 1409-1414 (2004), and Li et al., Nat Biotech 24, 210-215 (2006).

Suitable host cells for the expression of (glycosylated) polypeptides are also derived from multicellular organisms (invertebrates and vertebrates). Examples of invertebrate cells include plant and insect cells. Numerous baculoviral strains have been identified which may be used in conjunction with insect cells, particularly for transfection of Spodoptera frugiperda cells. Plant cell cultures can also be utilized as hosts. See e.g. U.S. Pat. Nos. 5,959,177, 6,040, 498, 6,420,548, 7,125,978, and 6,417,429 (describing PLANTIBODIES™ technology for producing antibodies in transgenic plants). Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293T cells as described, e.g., in Graham et al., J Gen Virol 36, 59 (1977)), baby hamster kidney cells (BHK), mouse sertoli cells (TM4 cells as described, e.g., in Mather, Biol Reprod 23, 243-251 (1980)), monkey kidney cells (CV1), African green monkey kidney cells (VERO-76), human cervical carcinoma cells (HELA), canine kidney cells (MDCK), buffalo rat liver cells (BRL 3A), human lung cells (W138), human liver cells (Hep G2), mouse mammary tumor cells (MMT 060562), TRI cells (as described, e.g., in Mather et al., Annals N.Y. Acad Sci 383, 44-68 (1982)), MRC 5 cells, and FS4 cells. Other useful mammalian host cell lines include Chinese hamster ovary (CHO) cells, including dhfr-CHO cells (Urlaub et al., Proc Natl Acad Sci USA 77, 4216 (1980)); and myeloma cell lines such as YO, NS0, P3X63 and Sp2/0. For a review of certain mammalian host cell lines suitable for protein production, see, e.g., Yazaki and Wu, Methods in Molecular Biology, Vol. 248 (B. K. C. Lo, ed., Humana Press, Totowa, N.J.), pp. 255-268 (2003). Host cells include cultured cells, e.g., mammalian cultured cells, yeast cells, insect cells, bacterial cells and plant cells, to name only a few, but also cells comprised within a transgenic animal, transgenic plant or cultured plant or animal tissue. In one embodiment, the host cell is a eukaryotic cell, preferably a mammalian cell, such as a Chinese Hamster Ovary (CHO) cell, a human embryonic kidney (HEK) cell or a lymphoid cell (e.g., Y0, NS0, Sp20 cell). Standard technologies are known in the art to express foreign genes in these systems. Cells expressing a polypeptide comprising either the heavy or the light chain of an immunoglobulin, may be engineered so as to also express the other of the immunoglobulin chains such that the expressed product is an immunoglobulin that has both a heavy and a light chain.

In one aspect, a method of producing a bispecific antigen binding molecule of the invention or polypeptide fragments thereof is provided, wherein the method comprises culturing a host cell comprising polynucleotides encoding the bispecific antigen binding molecule of the invention or polypeptide fragments thereof, as provided herein, under conditions suitable for expression of the bispecific antigen binding molecule of the invention or polypeptide fragments thereof, and recovering the bispecific antigen binding molecule of the invention or polypeptide fragments thereof from the host cell (or host cell culture medium).

Bispecific molecules of the invention prepared as described herein may be purified by art-known techniques such as high performance liquid chromatography, ion exchange chromatography, gel electrophoresis, affinity chromatography, size exclusion chromatography, and the like. The actual conditions used to purify a particular protein will depend, in part, on factors such as net charge, hydrophobicity, hydrophilicity etc., and will be apparent to those having skill in the art. For affinity chromatography purification an antibody, ligand, receptor or antigen can be used to which the bispecific antigen binding molecule binds. For example, for affinity chromatography purification of fusion proteins of the invention, a matrix with protein A or protein G may be used. Sequential Protein A or G affinity chromatography and size exclusion chromatography can be used to isolate an antigen binding molecule essentially as described in the examples. The purity of the bispecific antigen binding molecule or fragments thereof can be determined by any of a variety of well-known analytical methods including gel electrophoresis, high pressure liquid chromatography, and the like. For example, the bispecific antigen binding molecules expressed as described in the Examples were shown to be intact and properly assembled as demonstrated by reducing and non-reducing SDS-PAGE.

Assays

The antigen binding molecules provided herein may be identified, screened for, or characterized for their physical/chemical properties and/or biological activities by various assays known in the art.

1. Affinity Assays

The affinity of the bispecific antigen binding molecules, antibodies and antibody fragments provided herein for the corresponding TNF receptor can be determined in accordance with the methods set forth in the examples by surface plasmon resonance (SPR), using standard instrumentation such as a BIAcore instrument (GE Healthcare), and receptors or target proteins such as may be obtained by recombinant expression. The affinity of the bispecific antigen binding molecule for the target cell antigen can also be determined by surface plasmon resonance (SPR), using standard instrumentation such as a BIAcore instrument (GE Healthcare), and receptors or target proteins such as may be obtained by recombinant expression. A specific illustrative and exemplary embodiment for measuring binding affinity is described in Example 2. According to one aspect, $K_D$ is measured by surface plasmon resonance using a BIACORE® T100 machine (GE Healthcare) at 25° C.

2. Binding Assays and Other Assays

Binding of the bispecific antigen binding molecule provided herein to the corresponding receptor expressing cells may be evaluated using cell lines expressing the particular receptor or target antigen, for example by flow cytometry (FACS). In one aspect, peripheral blood mononuclear cells (PBMCs) expressing the TNF receptor are used in the binding assay. These cells are used directly after isolation (naïve PMBCs) or after stimulation (activated PMBCs). In another aspect, activated mouse splenocytes (expressing the TNF receptor molecule) were used to demonstrate the binding of the bispecific antigen binding molecule or antibody of the invention to the corresponding TNF receptor expressing cells. In a further aspect, PBMC isolated from heparinized blood of healthy *Macaca fascicularis* were used to show of the bispecific antigen binding molecule or antibody to the corresponding cynomolgus TNF receptor expressing cells.

In a further aspect, cancer cell lines expressing the target cell antigen, for example FAP, were used to demonstrate the binding of the antigen binding molecules to the target cell antigen.

In another aspect, competition assays may be used to identify an antigen binding molecule that competes with a specific antibody or antigen binding molecule for binding to the target or TNF receptor, respectively. In certain embodiments, such a competing antigen binding molecule binds to the same epitope (e.g., a linear or a conformational epitope) that is bound by a specific anti-target antibody or a specific anti-TNF receptor antibody. Detailed exemplary methods for mapping an epitope to which an antibody binds are provided in Morris (1996) "Epitope Mapping Protocols," in *Methods in Molecular Biology* vol. 66 (Humana Press, Totowa, N.J.).

3. Activity Assays

In one aspect, assays are provided for identifying bispecific antigen binding molecules that bind to a specific target cell antigen and to a specific TNF receptor having biological activity. Biological activity may include, e.g., agonistic signalling through the TNF receptor on cells expressing the target cell antigen. TNF family ligand trimer-containing antigen binding molecules identified by the assays as having such biological activity in vitro are also provided.

In certain aspects, a bispecific antigen binding molecule of the invention is tested for such biological activity. Furthermore, assays for detecting cell lysis (e.g. by measurement of LDH release), induced apoptosis kinetics (e.g. by measurement of Caspase 3/7 activity) or apoptosis (e.g. using the TUNEL assay) are well known in the art. In addition the biological activity of such complexes can be assessed by evaluating their effects on survival, proliferation and lymphokine secretion of various lymphocyte subsets such as NK cells, NKT-cells or γδ T-cells or assessing their capacity to modulate phenotype and function of antigen presenting cells such as dendritic cells, monocytes/macrophages or B-cells.

Pharmaceutical Compositions, Formulations and Routes of Administration

In a further aspect, the invention provides pharmaceutical compositions comprising any of the bispecific antigen binding molecules or antibodies provided herein, e.g., for use in any of the below therapeutic methods. In one embodiment, a pharmaceutical composition comprises any of the bispecific antigen binding molecules provided herein and at least one pharmaceutically acceptable excipient. In another embodiment, a pharmaceutical composition comprises any of the bispecific antigen binding molecules provided herein and at least one additional therapeutic agent, e.g., as described below.

Pharmaceutical compositions of the present invention comprise a therapeutically effective amount of one or more bispecific antigen binding molecules dissolved or dispersed in a pharmaceutically acceptable excipient. The phrases "pharmaceutical or pharmacologically acceptable" refers to molecular entities and compositions that are generally non-toxic to recipients at the dosages and concentrations employed, i.e. do not produce an adverse, allergic or other untoward reaction when administered to an animal, such as, for example, a human, as appropriate. The preparation of a pharmaceutical composition that contains at least one bispecific antigen binding molecule or antibody according to the invention and optionally an additional active ingredient will be known to those of skill in the art in light of the present disclosure, as exemplified by Remington's Pharmaceutical Sciences, 18th Ed. Mack Printing Company, 1990, incorporated herein by reference. In particular, the compositions are lyophilized formulations or aqueous solutions. As used herein, "pharmaceutically acceptable excipient" includes any and all solvents, buffers, dispersion media, coatings, surfactants, antioxidants, preservatives (e.g. antibacterial agents, antifungal agents), isotonic agents, salts, stabilizers and combinations thereof, as would be known to one of ordinary skill in the art.

Parenteral compositions include those designed for administration by injection, e.g. subcutaneous, intradermal, intralesional, intravenous, intraarterial intramuscular, intrathecal or intraperitoneal injection. For injection, the bispecific antigen binding molecules or antibodies of the invention may be formulated in aqueous solutions, preferably in physiologically compatible buffers such as Hanks' solution, Ringer's solution, or physiological saline buffer. The solution may contain formulatory agents such as suspending, stabilizing and/or dispersing agents. Alternatively, the bispecific antigen binding molecules or antibodies may be in powder form for constitution with a suitable vehicle, e.g., sterile pyrogen-free water, before use. Sterile injectable solutions are prepared by incorporating the antigen binding molecules of the invention in the required amount in the appropriate solvent with various of the other ingredients enumerated below, as required. Sterility may be readily accomplished, e.g., by filtration through sterile filtration membranes. Generally, dispersions are prepared by incorporating the various sterilized active ingredients into a sterile vehicle which contains the basic dispersion medium and/or the other ingredients. In the case of sterile powders for the preparation of sterile injectable solutions, suspensions or emulsion, the preferred methods of preparation are vacuum-drying or freeze-drying techniques which yield a powder of the active ingredient plus any additional desired ingredient from a previously sterile-filtered liquid medium thereof. The liquid medium should be suitably buffered if necessary and the liquid diluent first rendered isotonic prior to injection with sufficient saline or glucose. The composition must be stable under the conditions of manufacture and storage, and preserved against the contaminating action of microorganisms, such as bacteria and fungi. It will be appreciated that endotoxin contamination should be kept minimally at a safe level, for example, less that 0.5 ng/mg protein. Suitable pharmaceutically acceptable excipients include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG). Aqueous injection suspensions may contain compounds which increase the viscosity of the suspension, such as sodium carboxymethyl cellulose, sorbitol, dextran, or the like. Optionally, the suspension may also contain suitable stabilizers or agents which increase the solubility of the compounds to allow for the preparation of highly concentrated solutions. Additionally, suspensions of the active compounds may be prepared as appropriate oily injection suspensions. Suitable lipophilic solvents or vehicles include fatty oils such as sesame oil, or synthetic fatty acid esters, such as ethyl cleats or triglycerides, or liposomes.

Active ingredients may be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences (18th Ed. Mack Printing Company, 1990). Sustained-release preparations may be prepared. Suitable examples of sustained-release preparations include semipermeable matrices of solid hydrophobic polymers containing the polypeptide, which matrices are in the form of shaped articles, e.g. films, or microcapsules. In particular embodiments, prolonged absorption of an injectable composition can be brought about by the use in the compositions of agents delaying absorption, such as, for example, aluminum monostearate, gelatin or combinations thereof.

Exemplary pharmaceutically acceptable excipients herein further include insterstitial drug dispersion agents such as soluble neutral-active hyaluronidase glycoproteins (sHASEGP), for example, human soluble PH-20 hyaluronidase glycoproteins, such as rHuPH20 (HYLENEX®, Baxter International, Inc.). Certain exemplary sHASEGPs and methods of use, including rHuPH20, are described in US Patent Publication Nos. 2005/0260186 and 2006/0104968. In one aspect, a sHASEGP is combined with one or more additional glycosaminoglycanases such as chondroitinases.

Exemplary lyophilized antibody formulations are described in U.S. Pat. No. 6,267,958. Aqueous antibody formulations include those described in U.S. Pat. No. 6,171, 586 and WO2006/044908, the latter formulations including a histidine-acetate buffer.

In addition to the compositions described previously, the antigen binding molecules may also be formulated as a depot preparation. Such long acting formulations may be administered by implantation (for example subcutaneously or intramuscularly) or by intramuscular injection. Thus, for example, the fusion proteins may be formulated with suitable polymeric or hydrophobic materials (for example as emulsion in an acceptable oil) or ion exchange resins, or as sparingly soluble derivatives, for example, as a sparingly soluble salt.

Pharmaceutical compositions comprising the bispecific antigen binding molecules or antibodies of the invention may be manufactured by means of conventional mixing, dissolving, emulsifying, encapsulating, entrapping or lyophilizing processes. Pharmaceutical compositions may be formulated in conventional manner using one or more physiologically acceptable carriers, diluents, excipients or auxiliaries which facilitate processing of the proteins into preparations that can be used pharmaceutically. Proper formulation is dependent upon the route of administration chosen.

The bispecific antigen binding molecules may be formulated into a composition in a free acid or base, neutral or salt form. Pharmaceutically acceptable salts are salts that substantially retain the biological activity of the free acid or base. These include the acid addition salts, e.g. those formed with the free amino groups of a proteinaceous composition, or which are formed with inorganic acids such as for example, hydrochloric or phosphoric acids, or such organic acids as acetic, oxalic, tartaric or mandelic acid. Salts formed with the free carboxyl groups can also be derived from inorganic bases such as for example, sodium, potassium, ammonium, calcium or ferric hydroxides; or such organic bases as isopropylamine, trimethylamine, histidine or procaine. Pharmaceutical salts tend to be more soluble in aqueous and other protic solvents than are the corresponding free base forms.

The composition herein may also contain more than one active ingredients as necessary for the particular indication being treated, preferably those with complementary activities that do not adversely affect each other. Such active ingredients are suitably present in combination in amounts that are effective for the purpose intended.

The formulations to be used for in vivo administration are generally sterile. Sterility may be readily accomplished, e.g., by filtration through sterile filtration membranes.

Therapeutic Methods and Compositions

Any of the bispecific antigen binding molecules or antibodies provided herein may be used in therapeutic methods.

For use in therapeutic methods, bispecific antigen binding molecules or antibodies of the invention can be formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners.

In one aspect, bispecific antigen binding molecules or antibodies of the invention for use as a medicament are provided.

In further aspects, bispecific antigen binding molecules or antibodies of the invention for use (i) in stimulating or enhancing T cell response, (ii) for use in supporting survival of activated T cells, (iii) for use in the treatment of infections, (iv) for use in the treatment of cancer, (v) for use in delaying progression of cancer, or (vi) for use in prolonging the survival of a patient suffering from cancer, are provided. In a particular aspect, TNF family ligand trimer-containing antigen binding molecules or antibodies of the invention for use in treating a disease, in particular for use in the treatment of cancer, are provided.

In certain aspects, bispecific antigen binding molecules or antibodies of the invention for use in a method of treatment are provided. In one aspect, the invention provides a bispecific antigen binding molecule or antibody as described herein for use in the treatment of a disease in an individual in need thereof. In certain aspects, the invention provides a bispecific antigen binding molecule or antibody for use in a method of treating an individual having a disease comprising administering to the individual a therapeutically effective amount of the bispecific antigen binding molecule or antibody. In certain aspects the disease to be treated is cancer. The subject, patient, or "individual" in need of treatment is typically a mammal, more specifically a human.

In one aspect, provided is a method for (i) stimulating or enhancing T-cell response, (ii) supporting survival of activated T cells, (iii) treating infections, (iv) treating cancer, (v) delaying progression of cancer or (vi) prolonging the survival of a patient suffering from cancer, wherein the method comprises administering a therapeutically effective amount of the bispecific antigen binding molecule or antibody of the invention to an individual in need thereof.

In a further aspect, the invention provides for the use of the bispecific antigen binding molecule or antibody of the invention in the manufacture or preparation of a medicament for the treatment of a disease in an individual in need thereof. In one aspect the medicament is for use in a method of treating a disease comprising administering to an individual having the disease a therapeutically effective amount of the medicament. In certain aspects, the disease to be treated is a proliferative disorder, particularly cancer. Examples of cancers include, but are not limited to, bladder cancer, brain cancer, head and neck cancer, pancreatic cancer, lung cancer, breast cancer, ovarian cancer, uterine cancer, cervical cancer, endometrial cancer, esophageal cancer, colon cancer, colorectal cancer, rectal cancer, gastric cancer, prostate cancer, blood cancer, skin cancer, squamous cell carcinoma, bone cancer, and kidney cancer. Other examples of cancer include carcinoma, lymphoma (e.g., Hodgkin's and non-Hodgkin's lymphoma), blastoma, sarcoma, and leukemia. Other cell proliferation disorders that can be treated using the bispecific antigen binding molecule or antibody of the invention include, but are not limited to neoplasms located in the: abdomen, bone, breast, digestive system, liver, pancreas, peritoneum, endocrine glands (adrenal, parathyroid, pituitary, testicles, ovary, thymus, thyroid), eye, head and neck, nervous system (central and peripheral), lymphatic system, pelvic, skin, soft tissue, spleen, thoracic region, and urogenital system. Also included are pre-cancerous conditions or lesions and cancer metastases. In certain embodiments the cancer is chosen from the group consisting of renal cell cancer, skin cancer, lung cancer, colorectal cancer, breast cancer, brain cancer, head and neck cancer. A skilled artisan readily recognizes that in many cases the bispecific antigen binding molecule or antibody of the invention may not provide a cure but may provide a benefit. In some aspects, a physiological change having some benefit is also considered therapeutically beneficial. Thus, in some aspects, an amount of the bispecific antigen binding molecule or antibody of the invention that provides a physiological change is considered an "effective amount" or a "therapeutically effective amount".

For the prevention or treatment of disease, the appropriate dosage of a bispecific antigen binding molecule or antibody of the invention (when used alone or in combination with one or more other additional therapeutic agents) will depend on the type of disease to be treated, the route of administration, the body weight of the patient, the specific molecule, the severity and course of the disease, whether the bispecific antigen binding molecule or antibody of the invention is administered for preventive or therapeutic purposes, previous or concurrent therapeutic interventions, the patient's clinical history and response to the fusion protein, and the discretion of the attending physician. The practitioner responsible for administration will, in any event, determine the concentration of active ingredient(s) in a composition and appropriate dose(s) for the individual subject. Various dosing schedules including but not limited to single or multiple administrations over various time-points, bolus administration, and pulse infusion are contemplated herein.

The bispecific antigen binding molecule or antibody of the invention is suitably administered to the patient at one time or over a series of treatments. Depending on the type and severity of the disease, about 1 µg/kg to 15 mg/kg (e.g. 0.1 mg/kg-10 mg/kg) of TNF family ligand trimer-containing antigen binding molecule can be an initial candidate dosage for administration to the patient, whether, for example, by one or more separate administrations, or by continuous infusion. One typical daily dosage might range from about 1 µg/kg to 100 mg/kg or more, depending on the factors mentioned above. For repeated administrations over several days or longer, depending on the condition, the treatment would generally be sustained until a desired suppression of disease symptoms occurs. One exemplary dosage of the bispecific antigen binding molecule or antibody of the invention would be in the range from about 0.005 mg/kg to about 10 mg/kg. In other examples, a dose may also comprise from about 1 µg/kg body weight, about 5 µg/kg body weight, about 10 µg/kg body weight, about 50 µg/kg body weight, about 100 µg/kg body weight, about 200 µg/kg body weight, about 350 µg/kg body weight, about 500 µg/kg body weight, about 1 mg/kg body weight, about 5 mg/kg body weight, about 10 mg/kg body weight, about 50 mg/kg body weight, about 100 mg/kg body weight, about 200 mg/kg body weight, about 350 mg/kg body weight, about 500 mg/kg body weight, to about 1000 mg/kg body weight or more per administration, and any range derivable therein. In examples of a derivable range from the numbers listed herein, a range of about 5 mg/kg body weight to about 100 mg/kg body weight, about 5 µg/kg body weight to about 500 mg/kg body weight etc., can be administered, based on the numbers described above. Thus, one or more doses of about 0.5 mg/kg, 2.0 mg/kg, 5.0 mg/kg or 10 mg/kg (or any combination thereof) may be administered to the patient. Such doses may be administered intermittently, e.g. every week or every three weeks (e.g. such that the patient receives from about two to about twenty, or e.g. about six doses of the fusion protein). An initial higher loading dose, followed by one or more lower doses may be administered. However, other dosage regimens may be useful. The progress of this therapy is easily monitored by conventional techniques and assays.

The bispecific antigen binding molecule or antibody of the invention will generally be used in an amount effective to achieve the intended purpose. For use to treat or prevent a disease condition, the bispecific antigen binding molecule or antibody of the invention, or pharmaceutical compositions thereof, are administered or applied in a therapeutically effective amount. Determination of a therapeutically effective amount is well within the capabilities of those skilled in the art, especially in light of the detailed disclosure provided herein.

For systemic administration, a therapeutically effective dose can be estimated initially from in vitro assays, such as cell culture assays. A dose can then be formulated in animal models to achieve a circulating concentration range that includes the $IC_{50}$ as determined in cell culture. Such information can be used to more accurately determine useful doses in humans.

Initial dosages can also be estimated from in vivo data, e.g., animal models, using techniques that are well known in the art. One having ordinary skill in the art could readily optimize administration to humans based on animal data.

Dosage amount and interval may be adjusted individually to provide plasma levels of the bispecific antigen binding molecule or antibody of the invention which are sufficient to maintain therapeutic effect. Usual patient dosages for administration by injection range from about 0.1 to 50 mg/kg/day, typically from about 0.5 to 1 mg/kg/day. Therapeutically effective plasma levels may be achieved by administering multiple doses each day. Levels in plasma may be measured, for example, by HPLC.

In cases of local administration or selective uptake, the effective local concentration of the bispecific antigen binding molecule or antibody of the invention may not be related to plasma concentration. One skilled in the art will be able to optimize therapeutically effective local dosages without undue experimentation.

A therapeutically effective dose of the bispecific antigen binding molecule or antibody of the invention described herein will generally provide therapeutic benefit without causing substantial toxicity. Toxicity and therapeutic efficacy of a fusion protein can be determined by standard pharmaceutical procedures in cell culture or experimental animals. Cell culture assays and animal studies can be used to determine the $LD_{50}$ (the dose lethal to 50% of a population) and the $ED_{50}$ (the dose therapeutically effective in 50% of a population). The dose ratio between toxic and therapeutic effects is the therapeutic index, which can be expressed as the ratio $LD_{50}/ED_{50}$. Bispecific antigen binding molecules that exhibit large therapeutic indices are preferred. In one aspect, the bispecific antigen binding molecule or antibody of the invention exhibits a high therapeutic index. The data obtained from cell culture assays and animal studies can be used in formulating a range of dosages suitable for use in humans. The dosage lies preferably within a range of circulating concentrations that include the ED50 with little or no toxicity. The dosage may vary within this range depending upon a variety of factors, e.g., the dosage form employed, the route of administration utilized, the condition of the subject, and the like. The exact formulation, route of administration and dosage can be chosen by the individual physician in view of the patient's condition (see, e.g., Fingl et al., 1975, in: The Pharmacological Basis of Therapeutics, Ch. 1, p. 1, incorporated herein by reference in its entirety).

The attending physician for patients treated with fusion proteins of the invention would know how and when to terminate, interrupt, or adjust administration due to toxicity, organ dysfunction, and the like. Conversely, the attending physician would also know to adjust treatment to higher levels if the clinical response were not adequate (precluding toxicity). The magnitude of an administered dose in the management of the disorder of interest will vary with the severity of the condition to be treated, with the route of administration, and the like. The severity of the condition may, for example, be evaluated, in part, by standard prognostic evaluation methods. Further, the dose and perhaps dose frequency will also vary according to the age, body weight, and response of the individual patient.

Other Agents and Treatments

The bispecific antigen binding molecule or antibody of the invention may be administered in combination with one or more other agents in therapy. For instance, the bispecific antigen binding molecule or antibody of the invention of the invention may be co-administered with at least one additional therapeutic agent. The term "therapeutic agent" encompasses any agent that can be administered for treating a symptom or disease in an individual in need of such treatment. Such additional therapeutic agent may comprise any active ingredients suitable for the particular indication being treated, preferably those with complementary activities that do not adversely affect each other. In certain embodiments, an additional therapeutic agent is another anti-cancer agent, for example a microtubule disruptor, an antimetabolite, a topoisomerase inhibitor, a DNA intercalator, an alkylating agent, a hormonal therapy, a kinase inhibitor, a receptor antagonist, an activator of tumor cell apoptosis, or an antiangiogenic agent. In certain aspects, an additional therapeutic agent is an immunomodulatory agent, a cytostatic agent, an inhibitor of cell adhesion, a cytotoxic or cytostatic agent, an activator of cell apoptosis, or an agent that increases the sensitivity of cells to apoptotic inducers.

Such other agents are suitably present in combination in amounts that are effective for the purpose intended. The effective amount of such other agents depends on the amount of fusion protein used, the type of disorder or treatment, and other factors discussed above. The bispecific antigen binding molecule or antibody of the invention are generally used in the same dosages and with administration routes as described herein, or about from 1 to 99% of the dosages described herein, or in any dosage and by any route that is empirically/clinically determined to be appropriate.

Such combination therapies noted above encompass combined administration (where two or more therapeutic agents are included in the same or separate compositions), and separate administration, in which case, administration of the bispecific antigen binding molecule or antibody of the invention can occur prior to, simultaneously, and/or following, administration of the additional therapeutic agent and/or adjuvant.

Articles of Manufacture

In another aspect of the invention, an article of manufacture containing materials useful for the treatment, prevention and/or diagnosis of the disorders described above is provided. The article of manufacture comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing the condition and may have a sterile access port (for example the container may be an intravenous solution bag or a vial having a stopper that is pierceable by a hypodermic injection needle). At least one active agent in the composition is a bispecific antigen binding molecule or antibody of the invention.

The label or package insert indicates that the composition is used for treating the condition of choice. Moreover, the article of manufacture may comprise (a) a first container with a composition contained therein, wherein the composition comprises a bispecific antigen binding molecule of the invention; and (b) a second container with a composition contained therein, wherein the composition comprises a further cytotoxic or otherwise therapeutic agent. The article of manufacture in this embodiment of the invention may further comprise a package insert indicating that the compositions can be used to treat a particular condition.

Alternatively, or additionally, the article of manufacture may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

TABLE C (Sequences):

| SEQ ID NO: | Name | Sequence |
|---|---|---|
| 1 | Human OX40 ECD | Uniprot No. P43489, aa 29-214 |
| 2 | OX40(8H9, 49B4, 1G4, 20B7) CDR-H1 | SYAIS |
| 3 | OX40(CLC-563, CLC-564, 17A9) CDR-H1 | SYAMS |
| 4 | OX40(8H9, 49B4, 1G4, 20B7) CDR-H2 | GIIPIFGTANYAQKFQG |
| 5 | OX40(CLC-563, CLC-564, 17A9) CDR-H2 | AISGSGGSTYYADSVKG |
| 6 | OX40(8H9) CDR-H3 | EYGWMDY |
| 7 | OX40(49B4) CDR-H3 | EYYRGPYDY |
| 8 | OX40(1G4) CDR-H3 | EYGSMDY |
| 9 | OX40(20B7) CDR-H3 | VNYPYSYWGDFDY |
| 10 | OX40(CLC-563) CDR-H3 | DVGAFDY |
| 11 | OX40(CLC-564) CDR-H3 | DVGPFDY |
| 12 | OX40(17A9)-CDR-H3 | VFYRGGVSMDY |
| 13 | OX40(8H9, 49B4, 1G4, 20B7) CDR-L1 | RASQSISSWLA |
| 14 | OX40(CLC-563, CLC564) CDR-L1 | RASQSVSSSYLA |
| 15 | OX40(17A9) CDR-L1 | QGDSLRSYYAS |

TABLE C-continued (Sequences):

| SEQ ID NO: Name | Sequence |
|---|---|
| 16 OX40(8H9, 49B4, 1G4, 20B7) CDR-L2 | DASSLES |
| 17 OX40(CLC-563, CLC564) CDR-L2 | GASSRAT |
| 18 OX40(17A9) CDR-L2 | GKNNRPS |
| 19 OX40(8H9) CDR-L3 | QQYLTYSRFT |
| 20 OX40(49B4) CDR-L3 | QQYSSQPYT |
| 21 OX40(1G4) CDR-L3 | QQYISYSMLT |
| 22 OX40(20B7) CDR-L3 | QQYQAFSLT |
| 23 OX40(CLC-563, CLC-164) CDR-L3 | QQYGSSPLT |
| 24 OX40(17A9) CDR-L3 | NSRVMPHNRV |
| 25 OX40(8H9) VH | QVQLVQSGAEVKKPGSSVKVSCKASGGTFSSYAISW VRQAPGQGLEWMGGIIPIFGTANYAQKFQGRVTITA DKSTSTAYMELSSLRSEDTAVYYCAREYGWMDYW GQGTTVTVSS |
| 26 OX40(8H9) VL | DIQMTQSPSTLSASVGDRVTITCRASQSISSWLAWYQ QKPGKAPKLLIYDASSLESGVPSRFSGSGSGTEFTLTI SSLQPDDFATYYCQQYLTYSRFTFGQGTKVEIK |
| 27 OX40(49B4) VH | QVQLVQSGAEVKKPGSSVKVSCKASGGTFSSYAISW VRQAPGQGLEWMGGIIPIFGTANYAQKFQGRVTITA DKSTSTAYMELSSLRSEDTAVYYCAREYYRGPYDY WGQGTTVTVSS |
| 28 OX40(49B4) VL | DIQMTQSPSTLSASVGDRVTITCRASQSISSWLAWYQ QKPGKAPKLLIYDASSLESGVPSRFSGSGSGTEFTLTI SSLQPDDFATYYCQQYSSQPYTFGQGTKVEIK |
| 29 OX40(1G4) VH | QVQLVQSGAEVKKPGSSVKVSCKASGGTFSSYAISW VRQAPGQGLEWMGGIIPIFGTANYAQKFQGRVTITA DKSTSTAYMELSSLRSEDTAVYYCAREYGSMDYWG QGTTVTVSS |
| 30 OX40(1G4) VL | DIQMTQSPSTLSASVGDRVTITCRASQSISSWLAWYQ QKPGKAPKLLIYDASSLESGVPSRFSGSGSGTEFTLTI SSLQPDDFATYYCQQYISYSMLTFGQGTKVEIK |
| 31 OX40(20B7) VH | QVQLVQSGAEVKKPGSSVKVSCKASGGTFSSYAISW VRQAPGQGLEWMGGIIPIFGTANYAQKFQGRVTITA DKSTSTAYMELSSLRSEDTAVYYCARVNYPYSYWG DFDYWGQGTTVTVSS |
| 32 OX40(20B7) VL | DIQMTQSPSTLSASVGDRVTITCRASQSISSWLAWYQ QKPGKAPKLLIYDASSLESGVPSRFSGSGSGTEFTLTI SSLQPDDFATYYCQQYQAFSLTFGQGTKVEIK |
| 33 OX40(CLC-563) VH | EVQLLESGGGLVQPGGSLRLSCAASGFTFSSYAMSW VRQAPGKGLEWVSAISGSGGSTYYADSVKGRFTISR DNSKNTLYLQMNSLRAEDTAVYYCALDVGAFDYW GQGALVTVSS |
| 34 OX40(CLC-563) VL | EIVLTQSPGTLSLSPGERATLSCRASQSVSSSYLAWY QQKPGQAPRLLIYGASSRATGIPDRFSGSGSGTDFTLT ISRLEPEDFAVYYCQQYGSSPLTFGQGTKVEIK |
| 35 OX40(CLC-564) VH | EVQLLESGGGLVQPGGSLRLSCAASGFTFSSYAMSW VRQAPGKGLEWVSAISGSGGSTYYADSVKGRFTISR DNSKNTLYLQMNSLRAEDTAVYYCAFDVGPFDYWG QGTLVTVSS |
| 36 OX40(CLC-564) VL | EIVLTQSPGTLSLSPGERATLSCRASQSVSSSYLAWY QQKPGQAPRLLIYGASSRATGIPDRFSGSGSGTDFTLT ISRLEPEDFAVYYCQQYGSSPLTFGQGTKVEIK |

TABLE C-continued (Sequences):

| SEQ ID NO: | Name | Sequence |
|---|---|---|
| 37 | OX40(17A9) VH | EVQLLESGGGLVQPGGSLRLSCAASGFTFSSYAMSW VRQAPGKGLEWVSAISGSGGSTYYADSVKGRFTISR DNSKNTLYLQMNSLRAEDTAVYYCARVFYRGGVSM DYWGQGTLVTVSS |
| 38 | OX40(17A9) VL | SSELTQDPAVSVALGQTVRITCQGDSLRSYYASWYQ QKPGQAPVLVIYGKNNRPSGIPDRFSGSSSGNTASLTI TGAQAEDEADYYCNSRVMPHNRVFGGGTKLTV |
| 39 | Human 4-1BB ECD | Uniprot No. Q07011, aa 24-186 |
| 40 | 4-1BB(12B3, 11D5, 9B11, 20G2) CDR-H1 | SYAIS |
| 41 | 4-1BB(25G7) CDR-H1 | SYAMS |
| 42 | 4-1BB(12B3, 11D5, 9B11, 20G2) CDR-H2 | GIIPIFGTANYAQKFQG |
| 43 | 4-1BB(25G7) CDR-H2 | AISGSGGSTYYADSVKG |
| 44 | 4-1BB(12B3) CDR-H3 | SEFRFYADFDY |
| 45 | 4-1BB(25G7) CDR-H3 | DDPWPPFDY |
| 46 | 4-1BB(11D5) CDR-H3 | STLIYGYFDY |
| 47 | 4-1BB(9B11) CDR-H3 | SSGAYPGYFDY |
| 48 | 4-1BB(20G2) CDR-H3 | SYYWESYPFDY |
| 49 | 4-1BB(12B3, 11D5, 9B11, 20G2) CDR-L1 | RASQSISSWLA |
| 50 | 4-1BB(25G7) CDR-L1 | QGDSLRSYYAS |
| 51 | 4-1BB(12B3, 11D5, 9B11, 20G2) CDR-L2 | DASSLES |
| 52 | 4-1BB(25G7) CDR-L2 | GKNNRPS |
| 53 | 4-1BB(12B3) CDR-L3 | QQYHSYPQT |
| 54 | 4-1BB (25G7) CDR-L3 | NSLDRRGMWV |
| 55 | 4-1BB(11D5) CDR-L3 | QQLNSYPQT |
| 56 | 4-1BB(9B11) CDR-L3 | QQVNSYPQT |
| 57 | 4-1BB(20G2) CDR-L3 | QQQHSYYT |
| 58 | 4-1BB(12B3) VH | QVQLVQSGAEVKKPGSSVKVSCKASGGTFSSYAISW VRQAPGQGLEWMGGIIPIFGTANYAQKFQGRVTITA DKSTSTAYMELSSLRSEDTAVYYCARSEFRFYADFD YWGQGTTVTVSS |
| 59 | 4-1BB(12B3) VL | DIQMTQSPSTLSASVGDRVTITCRASQSISSWLAWYQ QKPGKAPKLLIYDASSLESGVPSRFSGSGSGTEFTLTI SSLQPDDFATYYCQQYHSYPQTFGQGTKVEIK |
| 60 | 4-1BB(25G7) VH | EVQLLESGGGLVQPGGSLRLSCAASGFTFSSYAMSW VRQAPGKGLEWVSAISGSGGSTYYADSVKGRFTISR DNSKNTLYLQMNSLRAEDTAVYYCARDDPWPPFDY WGQGTLVTVSS |
| 61 | 4-1BB(25G7) VL | SSELTQDPAVSVALGQTVRITCQGDSLRSYYASWYQ QKPGQAPVLVIYGKNNRPSGIPDRFSGSSSGNTASLTI TGAQAEDEADYYCNSLDRRGMWVFGGGTKLTV |
| 62 | 4-1BB(11D5) VH | QVQLVQSGAEVKKPGSSVKVSCKASGGTFSSYAISW VRQAPGQGLEWMGGIIPIFGTANYAQKFQGRVTITA DKSTSTAYMELSSLRSEDTAVYYCARSTLIYGYFDY WGQGTTVTVSS |

TABLE C-continued (Sequences):

| SEQ ID NO:Name | Sequence |
|---|---|
| 63 4-1BB(11D5) VL | DIQMTQSPSTLSASVGDRVTITC<u>RASQSISSWLA</u>WYQQKPGKAPKLLIY<u>DASSLES</u>GVPSRFSGSGSGTEFTLTISSLQPDDFATYYC<u>QQLNSYPQT</u>FGQGTKVEIK |
| 64 4-1BB(9B11) VH | QVQLVQSGAEVKKPGSSVKVSCKASGGTFS<u>SYAIS</u>WVRQAPGQGLEWMG<u>GIIPIFGTANYAQKFQ</u>GRVTITADKSTSTAYMELSSLRSEDTAVYYCAR<u>SSGAYPGYFDY</u>WGQGTTVTVSS |
| 65 4-1BB(9B11) VL | DIQMTQSPSTLSASVGDRVTITC<u>RASQSISSWLA</u>WYQQKPGKAPKLLIY<u>DASSLES</u>GVPSRFSGSGSGTEFTLTISSLQPDDFATYYC<u>QQVNSYPQT</u>FGQGTKVEIK |
| 66 4-1BB(20G2) VH | QVQLVQSGAEVKKPGSSVKVSCKASGGTFS<u>SYAIS</u>WVRQAPGQGLEWMG<u>GIIPIFGTANYAQKFQ</u>GRVTITADKSTSTAYMELSSLRSEDTAVYYCAR<u>SYYWESYPFDY</u>WGQGTTVTVSS |
| 67 4-1BB(20G2) VL | DIQMTQSPSTLSASVGDRVTITC<u>RASQSISSWLA</u>WYQQKPGKAPKLLIY<u>DASSLES</u>GVPSRFSGSGSGTEFTLTISSLQPDDFATYYC<u>QQQHSYYT</u>FGQGTKVEIK |
| 68 FAP(28H1) CDR-H1 | SHAMS |
| 69 FAP(4B9) CDR-H1 | SYAMS |
| 70 FAP(28H1) CDR-H2 | AIWASGEQYYADSVKG |
| 71 FAP(4B9) CDR-H2 | AIIGSGASTYYADSVKG |
| 72 FAP(28H1) CDR-H3 | GWLGNFDY |
| 73 FAP(4B9) CDR-H3 | GWFGGFNY |
| 74 FAP(28H1) CDR-L1 | RASQSVSRSYLA |
| 75 FAP(4B9) CDR-L1 | RASQSVTSSYLA |
| 76 FAP(28H1) CDR-L2 | GASTRAT |
| 77 FAP(4B9) CDR-L2 | VGSRRAT |
| 78 FAP(28H1) CDR-L3 | QQGQVIPPT |
| 79 FAP(4B9) CDR-L3 | QQGIMLPPT |
| 80 FAP(28H1) VH | EVQLLESGGGLVQPGGSLRLSCAASGFTFS<u>SHAMS</u>WVRQAPGKGLEWVS<u>AIWASGEQYYADSVKG</u>RFTISRDNSKNTLYLQMNSLRAEDTAVYYCAK<u>GWLGNFDY</u>WGQGTLVTVSS |
| 81 FAP(28H1) VL | EIVLTQSPGTLSLSPGERATLSC<u>RASQSVSRSYLA</u>WYQQKPGQAPRLLII<u>GASTRAT</u>GIPDRFSGSGSGTDFTLTISRLEPEDFAVYYC<u>QQGQVIPPT</u>FGQGTKVEIK |
| 82 FAP(4B9) VH | EVQLLESGGGLVQPGGSLRLSCAASGFTFS<u>SYAMS</u>WVRQAPGKGLEWVS<u>AIIGSGASTYYADSVKG</u>RFTISRDNSKNTLYLQMNSLRAEDTAVYYCAK<u>GWFGGFNY</u>WGQGTLVTVSS |
| 83 FAP(4B9) VL | EIVLTQSPGTLSLSPGERATLSC<u>RASQSVTSSYLA</u>WYQQKPGQAPRLLIN<u>VGSRRAT</u>GIPDRFSGSGSGTDFTLTISRLEPEDFAVYYC<u>QQGIMLPPT</u>FGQGTKVEIK |
| 84 Human (hu) FAP | UniProt no. Q12884 |
| 85 hu FAP ectodomain + poly-lys-tag + his$_6$-tag | RPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVP |

TABLE C-continued (Sequences):

| SEQ ID NO: Name | Sequence |
|---|---|
| | AMIASSDYYFSWLTWVTDERVCLQWLKRVQNVSVL SICDFREDWQTWDCPKTQEHIEESRTGWAGGFFVST PVFSYDAISYYKIFSDKDGYKHIHYIKDTVENAIQITS GKWEAINIFRVTQDSLFYSSNEFEEYPGRRNIYRISIGS YPPSKKCVTCHLRKERCQYYTASFSDYAKYYALVCY GPGIPISTLHDGRTDQEIKILEENKELENALKNIQLPKE EIKKLEVDEITLWYKMILPPQFDRSKKYPLLIQVYGG PCSQSVRSVFAVNWISYLASKEGMVIALVDGRGTAF QGDKLLYAVYRKLGVYEVEDQITAVRKFIEMGFIDE KRIAIWGWSYGGYVSSLALASGTGLFKCGIAVAPVSS WEYYASVYTERFMGLPTKDDNLEHYKNSTVMARAE YFRNVDYLLIHGTADDNVHFQNSAQIAKALVNAQV DFQAMWYSDQNHGLSGLSTNHLYTHMTHFLKQCFS LSDGKKKKKKGHHHHHH |
| 86 nucleotide sequence hu FAP ectodomain + poly-lys-tag + his$_6$-tag | CGCCCTTCAAGAGTTCATAACTCTGAAGAAAATAC AATGAGAGCACTCACACTGAAGGATATTTTAAATG GAACATTTTCTTATAAAACATTTTTTCCAAACTGGA TTTCAGGACAAGAATATCTTCATCAATCTGCAGAT AACAATATAGTACTTTATAATATTGAAACAGGACA ATCATATACCATTTTGAGTAATAGAACCATGAAAA GTGTGAATGCTTCAAATTACGGCTTATCACCTGAT CGGCAATTTGTATATCTAGAAAGTGATTATTCAAA GCTTTGGAGATACTCTTACACAGCAACATATTACA TCTATGACCTTAGCAATGGAGAATTTGTAAGAGGA AATGAGCTTCCTCGTCCAATTCAGTATTTATGCTGG TCGCCTGTTGGGAGTAAATTAGCATATGTCTATCA AAACAATATCTATTTGAAACAAAGACCAGGAGAT CCACCTTTTCAAATAACATTTAATGGAAGAGAAAA TAAAATATTTAATGGAATCCCAGACTGGGTTTATG AAGAGGAAATGCTTGCTACAAAATATGCTCTCTGG TGGTCTCCTAATGGAAAATTTTTGGCATATGCGGA ATTTAATGATACGGATATACCAGTTATTGCCTATTC CTATTATGGCGATGAACAATATCCTAGAACAATAA ATATTCCATACCCAAAGGCTGGAGCTAAGAATCCC GTTGTTCGGATATTTATTATCGATACCACTTACCCT GCGTATGTAGGTCCCCAGGAAGTGCCTGTTCCAGC AATGATAGCCTCAAGTGATTATTATTTCAGTTGGC TCACGTGGGTTACTGATGAACGAGTATGTTTGCAG TGGCTAAAAAGAGTCCAGAATGTTTCGGTCCTGTC TATATGTGACTTCAGGGAAGACTGGCAGACATGGG ATTGTCCAAAGACCCAGGAGCATATAGAAGAAAG CAGAACTGGATGGGCTGGTGGATTCTTTGTTTCAA CACCAGTTTTCAGCTATGATGCCATTTCGTACTACA AAATATTTAGTGACAAGGATGGCTACAAACATATT CACTATATCAAAGACACTGTGGAAAATGCTATTCA AATTACAAGTGGCAAGTGGGAGGCCATAAATATA TTCAGAGTAACACAGGATTCACTGTTTTATTCTAG CAATGAATTTGAAGAATACCCTGGAAGAAGAAAC ATCTACAGAATTAGCATTGGAAGCTATCCTCCAAG CAAGAAGTGTGTTACTTGCCATCTAAGGAAAGAAA GGTGCCAATATTACACAGCAAGTTTCAGCGACTAC GCCAAGTACTATGCACTTGTCTGCTACGGCCCAGG CATCCCCATTTCCACCCTTCATGATGGACGCACTG ATCAAGAATTAAATCCTGGAAGAAAACAAGGA ATTGGAAAATGCTTTGAAAAATATCCAGCTGCCTA AAGAGGAAATTAAGAAACTTGAAGTAGATGAAAT TACTTTATGGTACAAGATGATTCTTCCTCCTCAATT TGACAGATCAAAGAAGTATCCCTTGCTAATTCAAG TGTATGGTGGTCCCTGCAGTCAGAGTGTAAGGTCT GTATTTGCTGTTAATTGGATATCTTATCTTGCAAGT AAGGAAGGGATGGTCATTGCCTTGGTGGATGGTCG AGGAACAGCTTTCCAAGGTGACAAACTCCTCTATG CAGTGTATCGAAAGCTGGGTGTTTATGAAGTTGAA GACCAGATTACAGCTGTCAGAAAATTCATAGAAAT GGGTTTCATTGATGAAAAAGAATAGCCATATGGG GCTGGTCCTATGGAGGATACGTTTCATCACTGGCC CTTGCATCTGGAACTGGTCTTTTCAAATGTGGTATA GCAGTGGCTCCAGTCTCCAGCTGGGAATATTACGC GTCTGTCTACACAGAGAGATTCATGGGTCTCCCAA CAAAGGATGATAATCTTGAGCACTATAAGAATTCA ACTGTGATGGCAAGAGCAGAATATTTCAGAAATGT AGACTATCTTCTCATCCACGGAACAGCAGATGATA ATGTGCACTTTCAAAACTCAGCACAGATTGCTAAA |

TABLE C-continued (Sequences):

| SEQ ID NO: Name | Sequence |
|---|---|
| | GCTCTGGTTAATGCACAAGTGGATTTCCAGGCAAT<br>GTGGTACTCTGACCAGAACCACGGCTTATCCGGCC<br>TGTCCACGAACCACTTATACACCCACATGACCCAC<br>TTCCTAAAGCAGTGTTTCTCTTTGTCAGACGGCAA<br>AAAGAAAAAGAAAAAGGGCCACCACCATCACCAT<br>CAC |
| 87 mouse FAP | UniProt no. P97321 |
| 88 Murine FAP ectodomain + poly-lys-tag + his$_6$-tag | RPSRVYKPEGNTKRALTLKDILNGTFSYKTYFPNWIS<br>EQEYLHQSEDDNIVFYNIETRESYIILSNSTMKSVNAT<br>DYGLSPDRQFVYLESDYSKLWRYSYTATYYIYDLQN<br>GEFVRGYELPRPIQYLCWSPVGSKLAYVYQNNIYLK<br>QRPGDPPFQITYTGRENRIFNGIPDWVYEEEMLATKY<br>ALWWSPDGKFLAYVEFNDSDIPIIAYSYYGDGQYPR<br>TINIPYPKAGAKNPVVRVFIVDTTYPHHVGPMEVPVP<br>EMIASSDYYFSWLTWVSSERVCLQWLKRVQNVSVL<br>SICDFREDWHAWECPKNQEHVEESRTGWAGGFFVST<br>PAFSQDATSYYKIFSDKDGYKHIHYIKDTVENAIQITS<br>GKWEAIYIFRVTQDSLFYSSNEFEGYPGRRNIYRISIG<br>NSPPSKKCVTCHLRKERCQYYTASFSYKAKYYALVC<br>YGPGLPISTLHDGRTDQEIQVLEENKELENSLRNIQLP<br>KVEIKKLKDGGLTFWYKMILPPQFDRSKKYPLLIQVY<br>GGPCSQSVKSVFAVNWITYLASKEGIVIALVDGRGTA<br>FQGDKFLHAVYRKLGVYEVEDQLTAVRKFIEMGFID<br>EERIAIWGWSYGGYVSSLALASGTGLFKCGIAVAPVS<br>SWEYYASIYSERFMGLPTKDDNLEHYKNSTVMARA<br>EYFRNVDYLLIHGTADDNVHFQNSAQIAKALVNAQV<br>DFQAMWYSDQNHGILSGRSQNHLYTHMTHFLKQCF<br>SLSDGKKKKKGHHHHHH |
| 89 nucleotide sequence Murine FAP ectodomain + poly-lys-tag + his$_6$-tag | CGTCCCTCAAGAGTTTACAAACCTGAAGGAAACAC<br>AAAGAGAGCTCTTACCTTGAAGGATATTTTAAATG<br>GAACATTCTCATATAAAACATATTTTCCCAACTGG<br>ATTTCAGAACAAGAATATCTTCATCAATCTGAGGA<br>TGATAACATAGTATTTTATAATATTGAAACAAGAG<br>AATCATATATCATTTTGAGTAATAGCACCATGAAA<br>AGTGTGAATGCTACAGATTATGGTTTGTCACCTGA<br>TCGGCAATTTGTGTATCTAGAAAGTGATTATTCAA<br>AGCTCTGGCGATATTCATACACAGCGACATACTAC<br>ATCTACGACCTTCAGAATGGGGAATTTGTAAGAGG<br>ATACGAGCTCCCTCGTCCAATTCAGTATCTATGCT<br>GGTCGCCTGTTGGGAGTAAATTAGCATATGTATAT<br>CAAAACAATATTTATTTGAAACAAAGACCAGGAG<br>ATCCACCTTTTCAAATAACTTATACTGGAAGAGAA<br>AATAGAATATTTAATGGAATACCAGACTGGGTTTA<br>TGAAGAGGAAATGCTTGCCACAAAATATGCTCTTT<br>GGTGGTCTCCAGATGGAAAATTTTTGGCATATGTA<br>GAATTTAATGATTCAGATATACCAATTATTGCCTA<br>TTCTTATTATGGTGATGGACAGTATCCTAGAACTA<br>TAAATATTCCATATCCAAAGGCTGGGGCTAAGAAT<br>CCGGTTGTTCGTGTTTTTATTGTTGACACCACCTAC<br>CCTCACCACGTGGGCCCAATGGAAGTGCCAGTTCC<br>AGAAATGATAGCCTCAAGTGACTATTATTTCAGCT<br>GGCTCACATGGGTGTCCAGTGAACGAGTATGCTTG<br>CAGTGGCTAAAAAGAGTGCAGAATGTCTCAGTCCT<br>GTCTATATGTGATTTCAGGGAAGACTGGCATGCAT<br>GGGAATGTCCAAAGAACCAGGAGCATGTAGAAGA<br>AAGCAGAACAGGATGGCTGGTGGATTCTTTGTTT<br>CGACACCAGCTTTTAGCCAGGATGCCACTTCTTAC<br>TACAAAATATTTAGCGACAAGGATGGTTACAAACA<br>TATTCACTACATCAAAGACACTGTGGAAAATGCTA<br>TTCAAATTACAAGTGGCAAGTGGGAGGCCATATAT<br>ATATTCCGCGTAACACAGGATTCACTGTTTTATTCT<br>AGCAATGAATTTGAAGGTTACCCTGGAAGAAGAA<br>ACATCTACAGAATTAGCATTGGAAACTCTCCTCCG<br>AGCAAGAAGTGTGTTACTTGCCATCTAAGGAAAGA<br>AAGGTGCCAATATTACACAGCAAGTTTCAGCTACA<br>AAGCCAAGTACTATGCACTCGTCTGCTATGGCCCT<br>GGCCTCCCCATTTCCACCCTCCATGATGGCCGCAC<br>AGACCAAGAAATACAAGTATTAGAAGAAAACAAA<br>GAACTGGAAAATTCTCTGAGAAATATCCAGCTGCC<br>TAAAGTGGAGATTAAGAAGCTCAAAGACGGGGGA<br>CTGACTTTCTGGTACAAGATGATTCTGCCTCCTCAG |

TABLE C-continued

(Sequences):

| SEQ ID NO:Name | Sequence |
|---|---|
| | TTTGACAGATCAAAGAAGTACCCTTTGCTAATTCA<br>AGTGTATGGTGGTCCTTGTAGCCAGAGTGTTAAGT<br>CTGTGTTTGCTGTTAATTGGATAACTTATCTCGCAA<br>GTAAGGAGGGGATAGTCATTGCCCTGGTAGATGGT<br>CGGGGCACTGCTTTCCAAGGTGACAAATTCCTGCA<br>TGCCGTGTATCGAAAACTGGGTGTATATGAAGTTG<br>AGGACCAGCTCACAGCTGTCAGAAAATTCATAGA<br>AATGGGTTTCATTGATGAAGAAAGAATAGCCATAT<br>GGGGCTGGTCCTACGGAGGTTATGTTTCATCCCTG<br>GCCCTTGCATCTGGAACTGGTCTTTTCAAATGTGG<br>CATAGCAGTGGCTCCAGTCTCCAGCTGGGAATATT<br>ACGCATCTATCTACTCAGAGAGATTCATGGGCCTC<br>CCAACAAAGGACGACAATCTCGAACACTATAAAA<br>ATTCAACTGTGATGGCAAGAGCAGAATATTTCAGA<br>AATGTAGACTATCTTCTCATCCACGGAACAGCAGA<br>TGATAATGTGCACTTTCAGAACTCAGCACAGATTG<br>CTAAAGCTTTGGTTAATGCACAAGTGGATTTCCAG<br>GCGATGTGGTACTCTGACCAGAACCATGGTATATT<br>ATCTGGGCGCTCCCAGAATCATTTATATACCCACA<br>TGACGCACTTCCTCAAGCAATGCTTTTCTTTATCAG<br>ACGGCAAAAGAAAAAGAAAAAGGGCCACCACCA<br>TCACCATCAC |
| 90 Cynomolgus FAP ectodomain + poly-lys-tag + his$_6$-tag | RPPRVHNSEENTMRALTLKDILNGTFSYKTFFPNWIS<br>GQEYLHQSADNNIVLYNIETGQSYTILSNRTMKSVNA<br>SNYGLSPDRQFVYLESDYSKLWRYSYTATYYIYDLS<br>NGEFVRGNELPRPIQYLCWSPVGSKLAYVYQNNIYL<br>KQRPGDPPFQITFNGRENKIFNGIPDWVYEEEMLATK<br>YALWWSPNGKFLAYAEFNDTDIPVIAYSYYGDEQYP<br>RTINIPYPKAGAKNPFVRIFIIDTTYPAYVGPQEVPVP<br>AMIASSDYYFSWLTWVTDERVCLQWLKRVQNVSVL<br>SICDFREDWQTWDCPKTQEHIEESRTGWAGGGFFVST<br>PVFSYDAISYYKIFSDKDGYKHIHYIKDTVENAIQITS<br>GKWEAINIFRVTQDSLFYSSNEFEDYPGRRNIYRISIG<br>SYPPSKKCVTCHLRKERCQYYTASFSDYAKYYALVC<br>YGPGIPISTLHDGRTDQEIKILEENKELENALKNIQLP<br>KEEIKKLEVDEITLWYKMILPPQFDRSKKYPLLIQVY<br>GGPCSQSVRSVFAVNWISYLASKEGMVIALVDGRGT<br>AFQGDKLLYAVYRKLGVYEVEDQITAVRKFIEMGFI<br>DEKRIAIWGWSYGGYVSSLALASGTGLFKCGIAVAP<br>VSSWEYYASVYTERFMGLPTKDDNLEHYKNSTVMA<br>RAEYFRNVDYLLIHGTADDNVHFQNSAQIAKALVNA<br>QVDFQAMWYSDQNHGLSGLSTNHLYTHMTHFLKQ<br>CFSLSDGKKKKKGHHHHHH |
| 91 nucleotide sequence Cynomolgus FAP ectodomain + poly-lys-tag + his$_6$-tag | CGCCCTCCAAGAGTTCATAACTCTGAAGAAAATAC<br>AATGAGAGCACTCACACTGAAGGATATTTTAAATG<br>GGACATTTTCTTATAAAACATTTTTTCCAAACTGGA<br>TTTCAGGACAAGAATATCTTCATCAATCTGCAGAT<br>AACAATATAGTACTTTATAATATTGAAACAGGACA<br>ATCATATACCATTTTGAGTAACAGAACCATGAAAA<br>GTGTGAATGCTTCAAATTATGGCTTATCACCTGAT<br>CGGCAATTTGTATATCTAGAAAGTGATTATTCAAA<br>GCTTTGGAGATACTCTTACACAGCAACATATTACA<br>TCTATGACCTTAGCAATGGAGAATTTGTAAGAGGA<br>AATGAGCTTCCTCGTCCAATTCAGTATTTATGCTGG<br>TCGCCTGTTGGGAGTAAATTAGCATATGTCTATCA<br>AAACAATATCTATTTGAAACAAAGACCAGGAGAT<br>CCACCTTTTCAAATAACATTTAATGGAAGAGAAAA<br>TAAAATATTTAATGGAATCCCAGACTGGGTTTATG<br>AAGAGGAAATGCTTGCTACAAAATATGCTCTCTGG<br>TGGTCTCCTAATGGAAAATTTTTGGCATATGCGGA<br>ATTTAATGATACAGATATACCAGTTATTGCCTATTC<br>CTATTATGGCGATGAACAATATCCCAGAACAATAA<br>ATATTCCATACCCAAAGGCCGGAGCTAAGAATCCT<br>TTTGTTCGGATATTTATTATCGATACCACTTACCCT<br>GCGTATGTAGGTCCCCAGGAAGTGCCTGTTCCAGC<br>AATGATAGCCTCAAGTGATTATTTTCAGTTGGC<br>TCACGTGGGTTACTGATGAACAGTATGTTTGCAG<br>TGGCTAAAAAGAGTCCAGAATGTTTCGGTCTTGTC<br>TATATGTGATTTCAGGGAAGACTGGCAGACATGGG<br>ATTGTCCAAAGACCCAGGAGCATATAGAAGAAAG<br>CAGAACTGGATGGGCTGGTGGATTCTTTGTTTCAA<br>CACCAGTTTTCAGCTATGATGCCATTTCATACTACA |

TABLE C-continued (Sequences):

| SEQ ID NO: Name | Sequence |
|---|---|
| | AAATATTTAGTGACAAGGATGGCTACAAACATATT<br>CACTATATCAAAGACACTGTGGAAAATGCTATTCA<br>AATTACAAGTGGCAAGTGGGAGGCCATAAATATA<br>TTCAGAGTAACACAGGATTCACTGTTTTATTCTAG<br>CAATGAATTTGAAGATTACCCTGGAAGAAGAAAC<br>ATCTACAGAATTAGCATTGGAAGCTATCCTCCAAG<br>CAAGAAGTGTGTTACTTGCCATCTAAGGAAAGAAA<br>GGTGCCAATATTACACAGCAAGTTTCAGCGACTAC<br>GCCAAGTACTATGCACTTGTCTGCTATGGCCCAGG<br>CATCCCCATTTCCACCCTTCATGACGGACGCACTG<br>ATCAAGAAATTAAAATCCTGGAAGAAAACAAGGA<br>ATTGGAAAATGCTTTGAAAAATATCCAGCTGCCTA<br>AAGAGGAAATTAAGAAACTTGAAGTAGATGAAAT<br>TACTTTATGGTACAAGATGATTCTTCCTCCTCAATT<br>TGACAGATCAAAGAAGTATCCCTTGCTAATTCAAG<br>TGTATGGTGGTCCCTGCAGTCAGAGTGTAAGGTCT<br>GTATTTGCTGTTAATTGGATATCTTATCTTGCAAGT<br>AAGGAAGGGATGGTCATTGCCTTGGTGGATGGTCG<br>GGGAACAGCTTTCCAAGGTGACAAACTCCTGTATG<br>CAGTGTATCGAAAGCTGGGTGTTTATGAAGTTGAA<br>GACCAGATTACAGCTGTCAGAAAATTCATAGAAAT<br>GGGTTTCATTGATGAAAAAAGAATAGCCATATGGG<br>GCTGGTCCTATGGAGGATATGTTTCATCACTGGCC<br>CTTGCATCTGGAACTGGTCTTTTCAAATGTGGGAT<br>AGCAGTGGCTCCAGTCTCCAGCTGGGAATATTACG<br>CGTCTGTCTACACAGAGAGATTCATGGGTCTCCCA<br>ACAAAGGATGATAATCTTGAGCACTATAAGAATTC<br>AACTGTGATGGCAAGAGCAGAATATTTCAGAAAT<br>GTAGACTATCTTCTCATCCACGGAACAGCAGATGA<br>TAATGTGCACTTTCAAAACTCAGCACAGATTGCTA<br>AAGCTCTGGTTAATGCACAAGTGGATTTCCAGGCA<br>ATGTGGTACTCTGACCAGAACCACGGCTTATCCGG<br>CCTGTCCACGAACCACTTATACACCCACATGACCC<br>ACTTCCTAAAGCAGTGTTTCTCTTTGTCAGACGGC<br>AAAAAGAAAAAGAAAAAGGGCCACCACCATCACC<br>ATCAC |
| 92 human CEA | UniProt no. P06731 |
| 93 human MCSP | UniProt no. Q6UVK1 |
| 94 human EGFR | UniProt no. P00533 |
| 95 human CD19 | UniProt no. P15391 |
| 96 human CD20 | Uniprot no. P11836 |
| 97 human CD33 | UniProt no. P20138 |
| 98 human OX40 | UniProt no. P43489 |
| 99 human 4-1BB | UniProt no. Q07011 |
| 100 human CD27 | UniProt no. P26842 |
| 101 human HVEM | UniProt no. Q92956 |
| 102 human CD30 | UniProt no. P28908 |
| 103 human GITR | UniProt no. Q9Y5U5 |
| 104 murine OX40 | UniProt no. P47741 |
| 105 murine 4-1BB | UniProt no. P20334 |
| 106 cynomolgus 4-1BB | Uniprot no. F6W5G6 |
| 107 Peptide linker (G4S) | GGGGS |
| 108 Peptide linker (G4S)$_2$ | GGGGSGGGGS |
| 109 Peptide linker (SG4)$_2$ | SGGGGSGGGG |
| 110 Peptide linker G4(SG4)$_2$ | GGGGSGGGGSGGGG |

TABLE C-continued (Sequences):

| SEQ ID NO: Name | Sequence |
|---|---|
| 111 Peptide linker | GSPGSSSSGS |
| 112 Peptide linker (G4S)$_3$ | GGGGSGGGGSGGGGS |
| 113 Peptide linker (G4S)$_4$ | GGGGSGGGGSGGGGSGGGGS |
| 114 Peptide linker | GSGSGSGS |
| 115 Peptide linker | GSGSGNGS |
| 116 Peptide linker | GGSGSGSG |
| 117 Peptide linker | GGSGSG |
| 118 Peptide linker | GGSG |
| 119 Peptide linker | GGSGNGSG |
| 120 Peptide linker | GGNGSGSG |
| 121 Peptide linker | GGNGSG |
| 122 cynomolgus OX40 ECD | aa 29-214 |
| 123 murine OX40 ECD | aa 10-211 |
| 124 Nucleotide sequence Fc hole chain | see Table 2 |
| 125 Nucleotide sequence human OX40 antigen Fc knob chain | see Table 2 |
| 126 Nucleotide sequence cynomolgus OX40 antigen Fc knob chain | see Table 2 |
| 127 Nucleotide sequence murine OX40 antigen Fc knob chain | see Table 2 |
| 128 Fc hole chain | see Table 2 |
| 129 human OX40 antigen Fc knob chain | see Table 2 |
| 130 cynomolgus OX40 antigen Fc knob chain | see Table 2 |
| 131 murine OX40 antigen Fc knob chain | see Table 2 |
| 132 nucleotide sequence of library DP88-4 | see Table 3 |
| 133 nucleotide sequence of Fab light chain Vk1_5 | see Table 4 |
| 134 Fab light chain Vk1_5 | see Table 4 |
| 135 nucleotide sequence of Fab heavy chain VH1_69 | see Table 4 |
| 136 Fab heavy chain VH1_69 | see Table 4 |
| 137 LMB3 | see Table 5 |
| 138 Vk1_5_L3r_S | see Table 5 |
| 139 Vk1_5_L3r_SY | see Table 5 |
| 140 Vk1_5_L3r_SPY | see Table 5 |

TABLE C-continued (Sequences):

| SEQ ID NO: | Name | Sequence |
|---|---|---|
| 141 | RJH31 | see Table 5 |
| 142 | RJH32 | see Table 5 |
| 143 | DP88-v4-4 | see Table 5 |
| 144 | DP88-v4-6 | see Table 5 |
| 145 | DP88-v4-8 | see Table 5 |
| 146 | fdseqlong | see Table 5 |
| 147 | (Vk3_20/VH3_23) template | see Table 6 |
| 148 | nucleotide sequence of Fab light chain Vk3_20 | see Table 7 |
| 149 | Fab light chain Vk3_20 | see Table 7 |
| 150 | nucleotide sequence of Fab heavy chain VH3_23 | see Table 7 |
| 151 | Fab heavy chain VH3_23 (DP47) | see Table 7 |
| 152 | MS64 | see Table 8 |
| 153 | DP47CDR3_ba (mod.) | see Table 8 |
| 154 | DP47-v4-4 | see Table 8 |
| 155 | DP47-v4-6 | see Table 8 |
| 156 | DP47-v4-8 | see Table 8 |
| 157 | fdseqlong | see Table 8 |
| 158 | Vl3_19/VH3_23 library template | see Table 9 |
| 159 | nucleotide sequence of Fab light chain Vl3_19 | see Table 10 |
| 160 | Fab light chain Vl3_19 | see Table 10 |
| 161 | LMB3 | see Table 11 |
| 162 | Vl_3_19_L3r_V | see Table 11 |
| 163 | Vl_3_19_L3r_HV | see Table 11 |
| 164 | Vl_3_19_L3r_HLV | see Table 11 |
| 165 | RJH80 | see Table 11 |
| 166 | Nucleotide sequence OX40(8H9) VL | see Table 12 |
| 167 | Nucleotide sequence OX40(8H9) VH | see Table 12 |
| 168 | Nucleotide sequence OX40(49B4) VL | see Table 12 |
| 169 | Nucleotide sequence OX40(49B4) VH | see Table 12 |
| 170 | Nucleotide sequence OX40(1G4) VL | see Table 12 |
| 171 | Nucleotide sequence OX40(1G4) VH | see Table 12 |

TABLE C-continued (Sequences):

| SEQ ID NO: | Name | Sequence |
|---|---|---|
| 172 | Nucleotide sequence OX40(20B7) VL | see Table 12 |
| 173 | Nucleotide sequence OX40(20B7) VH | see Table 12 |
| 174 | Nucleotide sequence OX40(CLC-563) VL | see Table 12 |
| 175 | Nucleotide sequence OX40(CLC-563) VH | see Table 12 |
| 176 | Nucleotide sequence OX40(CLC-564) VL | see Table 12 |
| 177 | Nucleotide sequence OX40(CLC-564) VH | see Table 12 |
| 178 | Nucleotide sequence OX40(17A9) VL | see Table 12 |
| 179 | Nucleotide sequence OX40(17A9) VH | see Table 12 |
| 180 | 8H9 P329GLALA IgG1 (light chain) | nucleotide sequence, see Table 13 |
| 181 | 8H9 P329GLALA IgG1 (heavy chain) | nucleotide sequence, see Table 13 |
| 182 | 8H9 P329GLALA IgG1 (light chain) | see Table 13 |
| 183 | 8H9 P329GLALA IgG1 (heavy chain) | see Table 13 |
| 184 | 49B4 P329GLALA IgG1 (light chain) | nucleotide sequence, see Table 13 |
| 185 | 49B4 P329GLALA IgG1 (heavy chain) | nucleotide sequence, see Table 13 |
| 186 | 49B4 P329GLALA IgG1 (light chain) | see Table 13 |
| 187 | 49B4 P329GLALA IgG1 (heavy chain) | see Table 13 |
| 188 | 1G4 P329GLALA IgG1 (light chain) | nucleotide sequence, see Table 13 |
| 189 | 1G4 P329GLALA IgG1 (heavy chain) | nucleotide sequence, see Table 13 |
| 190 | 1G4 P329GLALA IgG1 (light chain) | see Table 13 |
| 191 | 1G4 P329GLALA IgG1 (heavy chain) | see Table 13 |
| 192 | 20B7 P329GLALA IgG1 (light chain) | nucleotide sequence, see Table 13 |
| 193 | 20B7 P329GLALA IgG1 (heavy chain) | nucleotide sequence, see Table 13 |
| 194 | 20B7 P329GLALA IgG1 (light chain) | see Table 13 |
| 195 | 20B7 P329GLALA IgG1 (heavy chain) | see Table 13 |

TABLE C-continued (Sequences):

| SEQ ID NO: | Name | Sequence |
|---|---|---|
| 196 | CLC-563 P329GLALA IgG1 (light chain) | nucleotide sequence, see Table 13 |
| 197 | CLC-563 P329GLALA IgG1 (heavy chain) | nucleotide sequence, see Table 13 |
| 198 | CLC-563 P329GLALA IgG1 (light chain) | see Table 13 |
| 199 | CLC-563 P329GLALA IgG1 (heavy chain) | see Table 13 |
| 200 | CLC-564 P329GLALA IgG1 (light chain) | nucleotide sequence, see Table 13 |
| 201 | CLC-564 P329GLALA IgG1 (heavy chain) | nucleotide sequence, see Table 13 |
| 202 | CLC-564 P329GLALA IgG1 (light chain) | see Table 13 |
| 203 | CLC-564 P329GLALA IgG1 (heavy chain) | see Table 13 |
| 204 | 17A9 P329GLALA IgG1 (light chain) | nucleotide sequence, see Table 13 |
| 205 | 17A9 P329GLALA IgG1 (heavy chain) | nucleotide sequence, see Table 13 |
| 206 | 17A9 P329GLALA IgG1 (light chain) | see Table 13 |
| 207 | 17A9 P329GLALA IgG1 (heavy chain) | see Table 13 |
| 208 | human OX40 His | nucleotide sequence |
| 209 | human OX40 His | see Table 15 |
| 210 | murine OX40 His | nucleotide sequence |
| 211 | murine OX40 His | see Table 15 |
| 212 | Nucleotide sequence of dimeric human OX40 antigen Fc | see Table 21 |
| 213 | dimeric human OX40 antigen Fc | see Table 21 |
| 214 | (8B9) VHCH1-Heavy chain-(28H1) VHCL | nucleotide sequence, see Table 25 |
| 215 | VLCH1-Light chain 2 (28H1) | nucleotide sequence, see Table 25 |
| 216 | (8B9) VHCH1-Heavy chain-(28H1) VHCL | see Table 25 |
| 217 | VLCH1-Light chain 2 (28H1) | see Table 25 |
| 218 | (49B4) VHCH1-Heavy chain-(28H1) VHCL | nucleotide sequence, see Table 25 |

TABLE C-continued (Sequences):

| SEQ ID NO: | Name | Sequence |
|---|---|---|
| 219 | (49B4) VHCH1-Heavy chain-(28H1) VHCL | see Table 25 |
| 220 | (1G4) VHCH1-Heavy chain-(28H1) VHCL | nucleotide sequence, see Table 25 |
| 221 | (1G4) VHCH1-Heavy chain-(28H1) VHCL | see Table 25 |
| 222 | (20B7) VHCH1-Heavy chain-(28H1) VHCL | nucleotide sequence, see Table 25 |
| 223 | (20B7) VHCH1-Heavy chain-(28H1) VHCL | see Table 25 |
| 224 | (CLC-563) VHCH1-Heavy chain-(28H1) VHCL | nucleotide sequence, see Table 25 |
| 225 | (CLC-563) VHCH1-Heavy chain-(28H1) VHCL | see Table 25 |
| 226 | (CLC-564) VHCH1-Heavy chain-(28H1) VHCL | nucleotide sequence, see Table 25 |
| 227 | (CLC-564) VHCH1-Heavy chain-(28H1) VHCL | see Table 25 |
| 228 | (28H1) VHCL-heavy chain hole | nucleotide sequence, see Table 27 |
| 229 | (28H1) VHCL-heavy chain hole | see Table 27 |
| 230 | (49B4) VHCH1-heavy chain knob | nucleotide sequence, see Table 27 |
| 231 | (49B4) VHCH1-heavy chain knob | see Table 27 |
| 232 | (1G4) VHCH1-heavy chain knob | nucleotide sequence, see Table 27 |
| 233 | (1G4) VHCH1-heavy chain knob | see Table 27 |
| 234 | (20B7) VHCH1-heavy chain knob | nucleotide sequence, see Table 27 |
| 235 | (20B7) VHCH1-heavy chain knob | see Table 27 |
| 236 | (CLC-563) VHCH1-heavy chain knob | nucleotide sequence, see Table 27 |
| 237 | (CLC-563) VHCH1-heavy chain knob | see Table 27 |
| 238 | (CLC-564) VHCH1-heavy chain knob | nucleotide sequence, see Table 27 |
| 239 | (CLC-564) VHCH1-heavy chain knob | see Table 27 |
| 240 | cynomolgus 4-1BB ECD | aa 24-186 |
| 241 | murine 4-1BB ECD | P20334, aa 24-187 |
| 242 | human 4-1BB antigen Fc knob chain | nucleotide sequence, see Table 37 |
| 243 | cynomolgus 4-1BB antigen Fc knob chain | nucleotide sequence, see Table 37 |

TABLE C-continued (Sequences):

| SEQ ID NO: | Name | Sequence |
|---|---|---|
| 244 | murine 4-1BB antigen Fc knob chain | nucleotide sequence, see Table 37 |
| 245 | human 4-1BB antigen Fc knob chain | see Table 37 |
| 246 | cynomolgus 4-1BB antigen Fc knob chain | see Table 37 |
| 247 | murine 4-1BB antigen Fc knob chain | see Table 37 |
| 248 | Primer MS63 | see Table 43 |
| 249 | Nucleotide sequence 4-1BB(12B3) VL | see Table 44 |
| 250 | Nucleotide sequence 4-1BB(12B3) VH | see Table 44 |
| 251 | Nucleotide sequence 4-1BB(25G7) VL | see Table 44 |
| 252 | Nucleotide sequence 4-1BB(25G7) VH | see Table 44 |
| 253 | Nucleotide sequence 4-1BB(11D5) VL | see Table 44 |
| 254 | Nucleotide sequence 4-1BB(11D5) VH | see Table 44 |
| 255 | Nucleotide sequence 4-1BB(9B11) VL | see Table 44 |
| 256 | Nucleotide sequence 4-1BB(9B11) VH | see Table 44 |
| 257 | Nucleotide sequence 4-1BB(20G2) VL | see Table 44 |
| 258 | Nucleotide sequence 4-1BB(20G2) VH | see Table 44 |
| 259 | 12B3 P329GLALA IgG1 (light chain) | nucleotide sequence, see Table 45 |
| 260 | 12B3 P329GLALA IgG1 (heavy chain) | nucleotide sequence, see Table 45 |
| 261 | 12B3 P329GLALA IgG1 (light chain) | see Table 45 |
| 262 | 12B3 P329GLALA IgG1 (heavy chain) | see Table 45 |
| 263 | 25G7 P329GLALA IgG1 (light chain) | nucleotide sequence, see Table 45 |
| 264 | 25G7 P329GLALA IgG1 (heavy chain) | nucleotide sequence, see Table 45 |
| 265 | 25G7 P329GLALA IgG1 (light chain) | see Table 45 |
| 266 | 25G7 P329GLALA IgG1 (heavy chain) | see Table 45 |
| 267 | 11D5 P329GLALA IgG1 (light chain) | nucleotide sequence, see Table 45 |
| 268 | 11D5 P329GLALA IgG1 (heavy chain) | nucleotide sequence, see Table 45 |

TABLE C-continued (Sequences):

| SEQ ID NO: | Name | Sequence |
|---|---|---|
| 269 | 11D5 P329GLALA IgG1 (light chain) | see Table 45 |
| 270 | 11D5 P329GLALA IgG1 (heavy chain) | see Table 45 |
| 271 | 9B11 P329GLALA IgG1 (light chain) | nucleotide sequence, see Table 45 |
| 272 | 9B11 P329GLALA IgG1 (heavy chain) | nucleotide sequence, see Table 45 |
| 273 | 9B11 P329GLALA IgG1 (light chain) | see Table 45 |
| 274 | 9B11 P329GLALA IgG1 (heavy chain) | see Table 45 |
| 275 | 20G2 P329GLALA IgG1 (light chain) | nucleotide sequence, see Table 45 |
| 276 | 20G2 P329GLALA IgG1 (heavy chain) | nucleotide sequence, see Table 45 |
| 277 | 20G2 P329GLALA IgG1 (light chain) | see Table 45 |
| 278 | 20G2 P329GLALA IgG1 (heavy chain) | see Table 45 |
| 279 | mu4-1BB D1/hu4-1BB D2 Fc knob | see Table 56 |
| 280 | hu4-1BB D1/mu4-1BB D2 Fc knob | see Table 56 |
| 281 | hu4-1BB D1 Fc knob | see Table 56 |
| 282 | Murine 4-1BB domain D1 (N-terminus) | see Table 57 |
| 283 | Human 4-1BB domain D2 (C-terminus) | see Table 57 |
| 284 | Human 4-1BB domain D1 (N-terminus) | see Table 57 |
| 285 | Murine 4-1BB domain D2 (C-terminus) | see Table 52 |
| 286 | (12B3) VHCH1-Heavy chain-(28H1) VHCL | nucleotide sequence, see Table 60 |
| 287 | (12B3) VHCH1-Heavy chain-(28H1) VHCL | see Table 60 |
| 288 | (25G7) VHCH1-Heavy chain-(28H1) VHCL | nucleotide sequence, see Table 60 |
| 289 | (25G7) VHCH1-Heavy chain-(28H1) VHCL | see Table 60 |
| 290 | (11D5) VHCH1-Heavy chain-(28H1) VHCL | nucleotide sequence, see Table 60 |
| 291 | (11D5) VHCH1-Heavy chain-(28H1) VHCL | see Table 60 |
| 292 | (9B11) VHCH1-Heavy chain-(28H1) VHCL | nucleotide sequence, see Table 60 |
| 293 | (9B11) VHCH1-Heavy chain-(28H1) VHCL | see Table 60 |

TABLE C-continued (Sequences):

| SEQ ID NO: | Name | Sequence |
|---|---|---|
| 294 | (12B3) VHCH1-heavy chain knob | nucleotide sequence, see Table 65 |
| 295 | (12B3) VHCH1-heavy chain knob | see Table 65 |
| 296 | (25G7) VHCH1-heavy chain knob | nucleotide sequence, see Table 65 |
| 297 | (25G7) VHCH1-heavy chain knob | see Table 65 |
| 298 | (11D5) VHCH1-heavy chain knob | nucleotide sequence, see Table 65 |
| 299 | (11D5) VHCH1-heavy chain knob | see Table 65 |
| 300 | (9B11) VHCH1-heavy chain knob | nucleotide sequence, see Table 65 |
| 301 | (9B11) VHCH1-heavy chain knob | see Table 65 |
| 302 | (8H9) VHCH1-heavy chain knob | nucleotide sequence, see Table 27 |
| 303 | (8H9) VHCH1-heavy chain knob | see Table 27 |
| 304 | (49B4) VHCH1 Fc knob VH (4B9) (nucleotide sequence of heavy chain 1) | see Table 30 |
| 305 | (49B4) VHCH1 Fc hole VL (4B9) (nucleotide sequence of heavy chain 2) | see Table 30 |
| 306 | (49B4) VHCH1 Fc knob VH (4B9) (heavy chain 1) | see Table 30 |
| 307 | (49B4) VHCH1 Fc hole VL (4B9) (heavy chain 2) | see Table 30 |
| 308 | (49B4) VHCH1 Fc knob VH (28H1) (nucleotide sequence, heavy chain 1) | see Table 30 |
| 309 | (49B4) VHCH1 Fc hole VL (28H1) (nucleotide sequence, heavy chain 2) | see Table 30 |
| 310 | (49B4) VHCH1 Fc knob VH (28H1) (heavy chain 1) | see Table 30 |
| 311 | (49B4) VHCH1 Fc hole VL (28H1) (heavy chain 2) | see Table 30 |
| 312 | (49B4) VHCH1 Fc knob VH (DP47) (nucleotide sequence, heavy chain 1) | see Table 30 |
| 313 | (49B4) VHCH1 Fc hole VL (DP47) (nucleotide sequence, heavy chain 2) | see Table 30 |
| 314 | (49B4) VHCH1 Fc knob VH (DP47) (heavy chain 1) | see Table 30 |

TABLE C-continued (Sequences):

| SEQ ID NO: Name | Sequence |
|---|---|
| 315 (49B4) VHCH1 Fc hole VL (DP47) (heavy chain 2) | see Table 30 |
| 316 (12B3) VHCH1 Fc knob VH (4B9) (nucleotide sequence of HC 1) | see Table 70 |
| 317 (12B3) VHCH1 Fc hole VL (4B9) (nucleotide sequence of HC2) | see Table 70 |
| 318 (12B3) VHCH1 Fc knob VH (4B9) (heavy chain 1) | see Table 70 |
| 319 (12B3) VHCH1 Fc hole VL (4B9) (heavy chain 2) | see Table 70 |
| 320 (25G7) VHCH1 Fc knob VH (4B9) (nucleotide sequence, heavy chain 1) | see Table 70 |
| 321 (25G7) VHCH1 Fc hole VL (4B9) (nucleotide sequence, heavy chain 2) | see Table 70 |
| 322 (25G7) VHCH1 Fc knob VH (4B9) (heavy chain 1) | see Table 70 |
| 323 (25G7) VHCH1 Fc hole VL (4B9) (heavy chain 2) | see Table 70 |
| 324 (11D5) VHCH1 Fc knob VH (4B9) (nucleotide sequence, heavy chain 1) | see Table 70 |
| 325 (11D5) VHCH1 Fc hole VL (4B9) (nucleotide sequence, heavy chain 2) | see Table 70 |
| 326 (11D5) VHCH1 Fc knob VH (4B9) (heavy chain 1) | see Table 70 |
| 327 (11D5) VHCH1 Fc hole VL (4B9) (heavy chain 2) | see Table 70 |
| 328 (9B11) VHCH1 Fc knob VH (4B9) (nucleotide sequence, heavy chain 1) | see Table 70 |
| 329 (9B11) VHCH1 Fc hole VL (4B9) (nucleotide sequence, heavy chain 2) | see Table 70 |
| 330 (9B11) VHCH1 Fc knob VH (4B9) (heavy chain 1) | see Table 70 |
| 331 (9B11) VHCH1 Fc hole VL (4B9) (heavy chain 2) | see Table 70 |
| 332 (12B3) VHCH1 Fc knob VL (4B9) (nucleotide sequence of HC 1) | see Table 71 |
| 333 (12B3) VHCH1 Fc hole VH (4B9) (nucleotide sequence of HC2) | see Table 71 |

TABLE C-continued (Sequences):

| SEQ ID NO | Name | Sequence |
|---|---|---|
| 334 | (12B3) VHCH1 Fc knob VL (4B9) (heavy chain 1) | see Table 71 |
| 335 | (12B3) VHCH1 Fc hole VH (4B9) (heavy chain 2) | see Table 71 |
| 336 | (25G7) VHCH1 Fc knob VL (4B9) (nucleotide sequence, heavy chain 1) | see Table 71 |
| 337 | (25G7) VHCH1 Fc hole VH (4B9) (nucleotide sequence, heavy chain 2) | see Table 71 |
| 338 | (25G7) VHCH1 Fc knob VL (4B9) (heavy chain 1) | see Table 71 |
| 339 | (25G7) VHCH1 Fc hole VH (4B9) (heavy chain 2) | see Table 71 |
| 340 | (11D5) VHCH1 Fc knob VL (4B9) (nucleotide sequence, heavy chain 1) | see Table 71 |
| 341 | (11D5) VHCH1 Fc hole VH (4B9) (nucleotide sequence, heavy chain 2) | see Table 71 |
| 342 | (11D5) VHCH1 Fc knob VL (4B9) (heavy chain 1) | see Table 71 |
| 343 | (11D5) VHCH1 Fc hole VH (4B9) (heavy chain 2) | see Table 71 |
| 344 | (9B11) VHCH1 Fc knob VL (4B9) (nucleotide sequence, heavy chain 1) | see Table 71 |
| 345 | (9B11) VHCH1 Fc hole VH (4B9) (nucleotide sequence, heavy chain 2) | see Table 71 |
| 346 | (9B11) VHCH1 Fc knob VL (4B9) (heavy chain 1) | see Table 71 |
| 347 | (9B11) VHCH1 Fc hole VH (4B9) (heavy chain 2) | see Table 71 |

All nucleotide sequences are presented without the respective stop codon sequences.

In the following specific embodiments of the invention are listed:

1. A bispecific antigen binding molecule, comprising
   (a) at least one moiety capable of specific binding to a costimulatory TNF receptor family member,
   (b) at least one moiety capable of specific binding to a target cell antigen, and
   (c) a Fc domain composed of a first and a second subunit capable of stable association.

2. The bispecific antigen binding molecule of claim 1, wherein the costimulatory TNF receptor family member is selected from the group consisting of OX40 and 4-1BB.

3. The bispecific antigen binding molecule of claims 1 or 2, wherein the costimulatory TNF receptor family member is OX40.

4. The bispecific antigen binding molecule of any one of claims 1 to 3, wherein the moiety capable of specific binding to a costimulatory TNF receptor family member binds to a polypeptide comprising the amino acid sequence of SEQ ID NO:1.

5. The bispecific antigen binding molecule of any one of claims 1 to 4, comprising at least one moiety capable of specific binding to OX40, wherein said moiety comprises a VH domain comprising (i) a CDR-H1 comprising the amino acid sequence selected from the group consisting of SEQ ID NO:2 and SEQ ID NO:3,
(ii) a CDR-H2 comprising the amino acid sequence selected from the group consisting of SEQ ID NO:4 and SEQ ID NO:5, and
(iii) a CDR-H3 comprising the amino acid sequence selected from the group consisting of SEQ ID NO:6, SEQ ID NO:7, SEQ ID NO:8, SEQ ID NO: 9, SEQ ID NO:10, SEQ ID NO:11 and SEQ ID NO:12, and a VL domain comprising
(iv) a CDR-L1 comprising the amino acid sequence selected from the group consisting of SEQ ID NO:13, SEQ ID NO:14 and SEQ ID NO:15,
(v) a CDR-L2 comprising the amino acid sequence selected from the group consisting of SEQ ID NO:16, SEQ ID NO:17 and SEQ ID NO:18, and
(vi) a CDR-L3 comprising the amino acid sequence selected from the group consisting of SEQ ID NO:19, SEQ ID NO:20, SEQ ID NO:21, SEQ ID NO:22, SEQ ID NO:23 and SEQ ID NO:24.

6. The bispecific antigen binding molecule of any one of claims 1 to 5, wherein the moiety capable of specific binding to OX40 comprises a heavy chain variable region VH comprising an amino acid sequence that is at least about 95%, 96%, 97%, 98%, 99% or 100% identical to an amino acid sequence selected from the group consisting of SEQ ID NO:25, SEQ ID NO: 27, SEQ ID NO:29, SEQ ID NO:31, SEQ ID NO:33, SEQ ID NO:35 and SEQ ID NO:37 and a light chain variable region VL comprising an amino acid sequence that is at least about 95%, 96%, 97%, 98%, 99% or 100% identical to an amino acid sequence of SEQ ID NO:26, SEQ ID NO: 28, SEQ ID NO:30, SEQ ID NO:30, SEQ ID NO:32, SEQ ID NO:34, SEQ ID NO:36 and SEQ ID NO:38.

7. The bispecific antigen binding molecule of any one of claims 1 to 5, wherein the moiety capable of specific binding to OX40 comprises
(i) a heavy chain variable region VH comprising an amino acid sequence of SEQ ID NO:25 and and a light chain variable region VL comprising an amino acid sequence of SEQ ID NO:26,
(ii) a heavy chain variable region VH comprising an amino acid sequence of SEQ ID NO:27 and and a light chain variable region VL comprising an amino acid sequence of SEQ ID NO:28,
(iii) a heavy chain variable region VH comprising an amino acid sequence of SEQ ID NO:29 and and a light chain variable region VL comprising an amino acid sequence of SEQ ID NO:30,
(iv) a heavy chain variable region VH comprising an amino acid sequence of SEQ ID NO:31 and and a light chain variable region VL comprising an amino acid sequence of SEQ ID NO:32,
(v) a heavy chain variable region VH comprising an amino acid sequence of SEQ ID NO:33 and and a light chain variable region VL comprising an amino acid sequence of SEQ ID NO:34,
(vi) a heavy chain variable region VH comprising an amino acid sequence of SEQ ID NO:35 and and a light chain variable region VL comprising an amino acid sequence of SEQ ID NO:36, or
(vii) a heavy chain variable region VH comprising an amino acid sequence of SEQ ID NO:37 and and a light chain variable region VL comprising an amino acid sequence of SEQ ID NO:38.

8. The bispecific antigen binding molecule of claims 1 or 2, wherein the costimulatory TNF receptor family member is 4-1BB.

9. The bispecific antigen binding molecule of any one of claims 1, 2 or 8, wherein the moiety capable of specific binding to a costimulatory TNF receptor family member binds to a polypeptide comprising the amino acid sequence of SEQ ID NO:39.

10. The bispecific antigen binding molecule of any one of claims 1, 2, 8 or 9, comprising at least one moiety capable of specific binding to 4-1BB, wherein said moiety comprises a VH domain comprising
(i) a CDR-H1 comprising the amino acid sequence selected from the group consisting of SEQ ID NO:40 and SEQ ID NO:41,
(ii) a CDR-H2 comprising the amino acid sequence selected from the group consisting of SEQ ID NO:42 and SEQ ID NO:43, and
(iii) a CDR-H3 comprising the amino acid sequence selected from the group consisting of SEQ ID NO:44, SEQ ID NO:45, SEQ ID NO:46, SEQ ID NO:47 and SEQ ID NO:48 and a VL domain comprising
(iv) a CDR-L1 comprising the amino acid sequence selected from the group consisting of SEQ ID NO:49 and SEQ ID NO:50,
(v) a CDR-L2 comprising the amino acid sequence selected from the group consisting of SEQ ID NO:51 and SEQ ID NO:52, and
(vi) a CDR-L3 comprising the amino acid sequence selected from the group consisting of SEQ ID NO:53, SEQ ID NO:54, SEQ ID NO:55, SEQ ID NO:56 and SEQ ID NO:57.

11. The bispecific antigen binding molecule of any one of claims 1, 2, 8, 9 or 10, wherein the moiety capable of specific binding to 4-1BB comprises a heavy chain variable region VH comprising an amino acid sequence that is at least about 95%, 96%, 97%, 98%, 99% or 100% identical to an amino acid sequence selected from the group consisting of SEQ ID NO:58, SEQ ID NO:60, SEQ ID NO:62, SEQ ID NO:64 and SEQ ID NO:66 and a light chain variable region comprising an amino acid sequence that is at least about 95%, 96%, 97%, 98%, 99% or 100% identical to an amino acid sequence selected from the group consisting of SEQ ID NO:59, SEQ ID NO:61, SEQ ID NO:63, SEQ ID NO:65 and SEQ ID NO:67.

12. The bispecific antigen binding molecule of any one of claims 1, 2 and 8 to 11, wherein the moiety capable of specific binding to 4-1BB comprises
(i) a heavy chain variable region VH comprising an amino acid sequence of SEQ ID NO:58 and and a light chain variable region VL comprising an amino acid sequence of SEQ ID NO:59,
(ii) a heavy chain variable region VH comprising an amino acid sequence of SEQ ID NO:60 and and a light chain variable region VL comprising an amino acid sequence of SEQ ID NO:61,
(iii) a heavy chain variable region VH comprising an amino acid sequence of SEQ ID NO:62 and and a light chain variable region VL comprising an amino acid sequence of SEQ ID NO:63,
(iv) a heavy chain variable region VH comprising an amino acid sequence of SEQ ID NO:64 and and a light chain variable region VL comprising an amino acid sequence of SEQ ID NO:65, or
(v) a heavy chain variable region VH comprising an amino acid sequence of SEQ ID NO:66 and and a light chain variable region VL comprising an amino acid sequence of SEQ ID NO:67.

13. The bispecific antigen binding molecule of any one of claims 1 to 12, wherein the target cell antigen is selected from the group consisting of Fibroblast Activation Protein (FAP), Melanoma-associated Chondroitin Sulfate Proteoglycan (MCSP), Epidermal Growth Factor Receptor (EGFR), Carcinoembryonic Antigen (CEA), CD19, CD20 and CD33.

14. The bispecific antigen binding molecule of any one of claims 1 to 13, wherein the target cell antigen is Fibroblast Activation Protein (FAP).

15. The bispecific antigen binding molecule of any one of claims 1 to 13, wherein the moiety capable of specific binding to FAP comprises a VH domain comprising
   (i) a CDR-H1 comprising the amino acid sequence selected from the group consisting of SEQ ID NO:68 and SEQ ID NO:69,
   (ii) a CDR-H2 comprising the amino acid sequence selected from the group consisting of SEQ ID NO:70 and SEQ ID NO:71, and
   (iii) a CDR-H3 comprising the amino acid sequence selected from the group consisting of SEQ ID NO:72 and SEQ ID NO:73,
and a VL domain comprising
   (iv) a CDR-L1 comprising the amino acid sequence selected from the group consisting of SEQ ID NO:74 and SEQ ID NO:75,
   (v) a CDR-L2 comprising the amino acid sequence selected from the group consisting of SEQ ID NO:76 and SEQ ID NO:77, and
   (vi) a CDR-L3 comprising the amino acid sequence selected from the group consisting of SEQ ID NO:78 and SEQ ID NO:79.

16. The bispecific antigen binding molecule of any one of claims 1 to 7, wherein
(i) the moiety capable of specific binding to OX40 comprises a heavy chain variable region VH comprising an amino acid sequence that is at least about 95%, 96%, 97%, 98%, 99% or 100% identical to the amino acid sequence of SEQ ID NO:25, SEQ ID NO: 27, SEQ ID NO:29, SEQ ID NO:31, SEQ ID NO:33, SEQ ID NO:35 or SEQ ID NO:37 and a light chain variable region comprising an amino acid sequence that is at least about 95%, 96%, 97%, 98%, 99% or 100% identical to the amino acid sequence of SEQ ID NO:26, SEQ ID NO: 28, SEQ ID NO:30, SEQ ID NO:32, SEQ ID NO:34, SEQ ID NO:36 or SEQ ID NO:38 and
(ii) the moiety capable of specific binding to FAP comprises a heavy chain variable region VH comprising an amino acid sequence that is at least about 95%, 96%, 97%, 98%, 99% or 100% identical to the amino acid sequence of SEQ ID NO:80 or SEQ ID NO:82 and a light chain variable region comprising an amino acid sequence that is at least about 95%, 96%, 97%, 98%, 99% or 100% identical to the amino acid sequence of SEQ ID NO:81 or SEQ ID NO:83.

17. The bispecific antigen binding molecule of any one of claims 1, 2 or 8 to 12, wherein
(i) the moiety capable of specific binding to 4-1BB comprises a heavy chain variable region VH comprising an amino acid sequence that is at least about 95%, 96%, 97%, 98%, 99% or 100% identical to the amino acid sequence of SEQ ID NO:58, SEQ ID NO:60, SEQ ID NO:62, SEQ ID NO:64 or SEQ ID NO:66 and a light chain variable region comprising an amino acid sequence that is at least about 95%, 96%, 97%, 98%, 99% or 100% identical to the amino acid sequence of SEQ ID NO:59, SEQ ID NO:61, SEQ ID NO:63, SEQ ID NO:65 or SEQ ID NO:67 and
(ii) the moiety capable of specific binding to FAP comprises a heavy chain variable region VH comprising an amino acid sequence that is at least about 95%, 96%, 97%, 98%, 99% or 100% identical to the amino acid sequence of SEQ ID NO:80 or SEQ ID NO:82 and a light chain variable region comprising an amino acid sequence that is at least about 95%, 96%, 97%, 98%, 99% or 100% identical to the amino acid sequence of SEQ ID NO:81 or SEQ ID NO:83.

18. The bispecific antigen binding molecule of any one of claims 1 to 17, wherein said molecule comprises
   (a) a first Fab fragment capable of specific binding to a costimulatory TNF receptor family member,
   (b) a second Fab fragment capable of specific binding to a target cell antigen, and
   (c) a Fc domain composed of a first and a second subunit capable of stable association.

19. The bispecific antigen binding molecule of any one of claims 1 to 18, wherein the Fc domain is an IgG, particularly an IgG1 Fc domain or an IgG4 Fc domain.

20. The bispecific antigen binding molecule of any one of claims 1 to 19, wherein the Fc domain comprises one or more amino acid substitution that reduces the binding affinity of the antibody to an Fc receptor and/or effector function.

21. The bispecific antigen binding molecule of any one of claims 1 to 20, wherein the Fc domain is of human IgG1 subclass with the amino acid mutations L234A, L235A and P329G (numbering according to Kabat EU index).

22. The bispecific antigen binding molecule of any one of claims 1 to 21, wherein the Fc domain comprises a modification promoting the association of the first and second subunit of the Fc domain.

23. The bispecific antigen binding molecule of any one of claims 1 to 22, wherein the first subunit of the Fc domain comprises knobs and the second subunit of the Fc domain comprises holes according to the knobs into holes method.

24. The bispecific antibody of any one of claims 1 to 23, wherein the first subunit of the Fc domain comprises the amino acid substitutions S354C and T366W (numbering according to Kabat EU index) and the second subunit of the Fc domain comprises the amino acid substitutions Y349C, T366S and Y407V (numbering according to Kabat EU index).

25. The bispecific antigen binding molecule of any one of claims 1 to 24, comprising
(a) two moieties capable of specific binding to a costimulatory TNF receptor family member,
(b) two moieties capable of specific binding to a target cell antigen, and
(c) a Fc domain composed of a first and a second subunit capable of stable association.

26. The bispecific antigen binding molecule of claim 25, wherein the bispecific antigen binding molecule is bivalent both for the costimulatory TNF receptor family member and for the target cell antigen.

27. The bispecific antigen binding molecule of any one of claims 1 to 24, comprising
(a) two light chains and two heavy chains of an antibody comprising two Fab fragments capable of specific binding to a costimulatory TNF receptor family member and the Fc domain, and
(b) two additional Fab fragments capable of specific binding to a target cell antigen, wherein said additional Fab fragments are each connected via a peptide linker to the C-terminus of the heavy chains of (a).

28. The bispecific antigen binding molecule of claim 27, wherein the two additional Fab fragments capable of specific binding to a target cell antigen are crossover Fab fragments wherein the variable domains VL and VH are replaced by each other and the VL-CH chains are each connected via a peptide linker to the C-terminus of the heavy chains of (a).

29. The bispecific antigen binding molecule of claim 27 or 28, wherein the two Fab fragments capable of specific binding to a costimulatory TNF receptor family member are two Fab fragments capable of specific binding to OX40 or 4-1BB and the two additional Fab fragments capable of specific binding to a target cell antigen are crossover Fab fragments capable of specific binding to FAP.

30. The bispecific antigen binding molecule of any one of the preceding claims, comprising
(a) two moieties capable of specific binding to a costimulatory TNF receptor family member,
(b) one moiety capable of specific binding to a target cell antigen, and
(c) a Fc domain composed of a first and a second subunit capable of stable association.

31. The bispecific antigen binding molecule of claim 30, wherein the bispecific antigen binding molecule is bivalent for the costimulatory TNF receptor family member and monovalent for the target cell antigen.

32. The bispecific antigen binding molecule of any one of preceding claims, comprising
(a) two light chains and two heavy chains of an antibody comprising two Fab fragments capable of specific binding to a costimulatory TNF receptor family member and the Fc domain, and
(b) a VH and VL domain capable of specific binding to a target cell antigen, wherein the VH domain is connected via a peptide linker to the C-terminus of one of the heavy chains and wherein the VL domain is connected via a peptide linker to the C-terminus of the second heavy chain.

33. A polynucleotide encoding the bispecific antigen binding molecule of any one of claims 1 to 32.

34. An antibody that specifically binds to OX40, wherein said antibody comprises
(i) a heavy chain variable region VH comprising an amino acid sequence of SEQ ID NO:25 and and a light chain variable region VL comprising an amino acid sequence of SEQ ID NO:26,
(ii) a heavy chain variable region VH comprising an amino acid sequence of SEQ ID NO:27 and and a light chain variable region VL comprising an amino acid sequence of SEQ ID NO:28,
(iii) a heavy chain variable region VH comprising an amino acid sequence of SEQ ID NO:29 and and a light chain variable region VL comprising an amino acid sequence of SEQ ID NO:30,
(iv) a heavy chain variable region VH comprising an amino acid sequence of SEQ ID NO:31 and and a light chain variable region VL comprising an amino acid sequence of SEQ ID NO:32,
(v) a heavy chain variable region VH comprising an amino acid sequence of SEQ ID NO:33 and and a light chain variable region VL comprising an amino acid sequence of SEQ ID NO:34,
(vi) a heavy chain variable region VH comprising an amino acid sequence of SEQ ID NO:35 and and a light chain variable region VL comprising an amino acid sequence of SEQ ID NO:36, or
(vii) a heavy chain variable region VH comprising an amino acid sequence of SEQ ID NO:37 and and a light chain variable region VL comprising an amino acid sequence of SEQ ID NO:38.

35. An antibody that specifically binds to 4-1BB, wherein said antibody comprises
(i) a heavy chain variable region VH comprising an amino acid sequence of SEQ ID NO:58 and and a light chain variable region VL comprising an amino acid sequence of SEQ ID NO:59,
(ii) a heavy chain variable region VH comprising an amino acid sequence of SEQ ID NO:60 and and a light chain variable region VL comprising an amino acid sequence of SEQ ID NO:61,
(iii) a heavy chain variable region VH comprising an amino acid sequence of SEQ ID NO:62 and and a light chain variable region VL comprising an amino acid sequence of SEQ ID NO:63,
(iv) a heavy chain variable region VH comprising an amino acid sequence of SEQ ID NO:64 and and a light chain variable region VL comprising an amino acid sequence of SEQ ID NO:65, or
(v) a heavy chain variable region VH comprising an amino acid sequence of SEQ ID NO:66 and and a light chain variable region VL comprising an amino acid sequence of SEQ ID NO:67.

36. A polynucleotide encoding the antibody of claims 34 or 35.

37. A pharmaceutical composition comprising a bispecific antigen binding molecule of any one of claims 1 to 32 or an antibody of claims 34 or 35 and at least one pharmaceutically acceptable excipient.

38. The bispecific antigen binding molecule of any one of claims 1 to 32, or the antibody of claims 34 or 35, or the pharmaceutical composition of claim 37, for use as a medicament.

39. The bispecific antigen binding molecule of any one of claims 1 to 32, or the antibody of claim 34 or 35, or the pharmaceutical composition of claim 37, for use
(i) in stimulating T cell response,
(ii) in supporting survival of activated T cells,
(iii) in the treatment of infections,
(iv) in the treatment of cancer,
(v) in delaying progression of cancer, or
(vi) in prolonging the survival of a patient suffering from cancer.

40. The bispecific antigen binding molecule of any one of claims 1 to 32, or the antibody of claims 34 or 35, or the pharmaceutical composition of claim 37, for use in the treatment of cancer.

41. The bispecific antigen binding molecule of any one of claims 1 to 32, or the antibody of claims 34 or 35, or the pharmaceutical composition of claim 37, for use in the treatment of cancer, wherein the bispecific antigen binding molecule is administered in combination with a chemotherapeutic agent, radiation and/or other agents for use in cancer immunotherapy.

42. A method of inhibiting the growth of tumor cells in an individual comprising administering to the individual an effective amount of the bispecific antigen binding molecule of any one of claims 1 to 32, or the antibody of claims 34 or 35, or the pharmaceutical composition of claim 37, to inhibit the growth of the tumor cells.

EXAMPLES

The following are examples of methods and compositions of the invention. It is understood that various other embodiments may be practiced, given the general description provided above.

Recombinant DNA Techniques

Standard methods were used to manipulate DNA as described in Sambrook et al., Molecular cloning: A laboratory manual; Cold Spring Harbor Laboratory Press, Cold Spring Harbor, N.Y., 1989. The molecular biological reagents were used according to the manufacturer's instructions. General information regarding the nucleotide sequences of human immunoglobulin light and heavy chains is given in: Kabat, E. A. et al., (1991) Sequences of Proteins of Immunological Interest, Fifth Ed., NIH Publication No 91-3242.

DNA Sequencing

DNA sequences were determined by double strand sequencing.

Gene Synthesis

Desired gene segments were either generated by PCR using appropriate templates or were synthesized by Geneart AG (Regensburg, Germany) from synthetic oligonucleotides and PCR products by automated gene synthesis. In cases where no exact gene sequence was available, oligonucleotide primers were designed based on sequences from closest homologues and the genes were isolated by RT-PCR from RNA originating from the appropriate tissue. The gene segments flanked by singular restriction endonuclease cleavage sites were cloned into standard cloning/sequencing vectors. The plasmid DNA was purified from transformed bacteria and concentration determined by UV spectroscopy. The DNA sequence of the subcloned gene fragments was confirmed by DNA sequencing. Gene segments were designed with suitable restriction sites to allow sub-cloning into the respective expression vectors. All constructs were designed with a 5'-end DNA sequence coding for a leader peptide which targets proteins for secretion in eukaryotic cells.

Protein Purification

Proteins were purified from filtered cell culture supernatants referring to standard protocols. In brief, antibodies were applied to a Protein A Sepharose column (GE healthcare) and washed with PBS. Elution of antibodies was achieved at pH 2.8 followed by immediate neutralization of the sample. Aggregated protein was separated from monomeric antibodies by size exclusion chromatography (Superdex 200, GE Healthcare) in PBS or in 20 mM Histidine, 150 mM NaCl pH 6.0. Monomeric antibody fractions were pooled, concentrated (if required) using e.g., a MILLIPORE Amicon Ultra (30 MWCO) centrifugal concentrator, frozen and stored at −20° C. or −80° C. Part of the samples were provided for subsequent protein analytics and analytical characterization e.g. by SDS-PAGE, size exclusion chromatography (SEC) or mass spectrometry.

SDS-PAGE

The NuPAGE® Pre-Cast gel system (Invitrogen) was used according to the manufacturer's instruction. In particular, 10% or 4-12% NuPAGE® Novex® Bis-TRIS Pre-Cast gels (pH 6.4) and a NuPAGE® MES (reduced gels, with NuPAGE® Antioxidant running buffer additive) or MOPS (non-reduced gels) running buffer was used.

Analytical Size Exclusion Chromatography

Size exclusion chromatography (SEC) for the determination of the aggregation and oligomeric state of antibodies was performed by HPLC chromatography. Briefly, Protein A purified antibodies were applied to a Tosoh TSKgel G3000SW column in 300 mM NaCl, 50 mM $KH_2PO_4$/$K_2HPO_4$, pH 7.5 on an Agilent HPLC 1100 system or to a Superdex 200 column (GE Healthcare) in 2×PBS on a Dionex HPLC-System. The eluted protein was quantified by UV absorbance and integration of peak areas. BioRad Gel Filtration Standard 151-1901 served as a standard.

Mass Spectrometry

This section describes the characterization of the multispecific antibodies with VH/VL or CH/CL exchange (CrossMabs) with emphasis on their correct assembly. The expected primary structures were analyzed by electrospray ionization mass spectrometry (ESI-MS) of the deglycosylated intact CrossMabs and deglycosylated/plasmin digested or alternatively deglycosylated/limited LysC digested CrossMabs.

The CrossMabs were deglycosylated with N-Glycosidase F in a phosphate or Tris buffer at 37° C. for up to 17 h at a protein concentration of 1 mg/ml. The plasmin or limited LysC (Roche) digestions were performed with 100 µg deglycosylated VH/VL CrossMabs in a Tris buffer pH 8 at room temperature for 120 hours and at 37° C. for 40 min, respectively. Prior to mass spectrometry the samples were desalted via HPLC on a Sephadex G25 column (GE Healthcare). The total mass was determined via ESI-MS on a maXis 4G UHR-QTOF MS system (Bruker Daltonik) equipped with a TriVersa NanoMate source (Advion).

Example 1

Figure 1A:
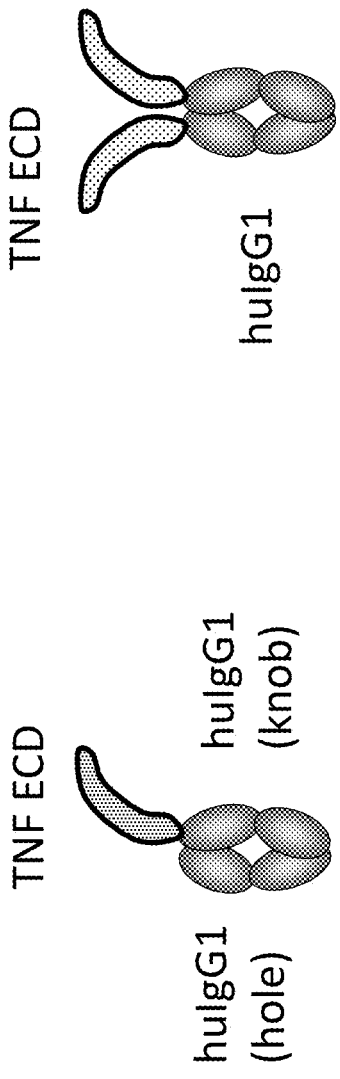
FIG. 1A shows the monomeric form of Fc-linked TNF receptor antigen that was used for the preparation of TNF receptor antibodies.
Figure 1C:
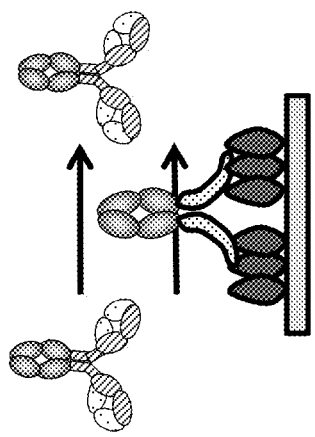
FIG. 1C shows the schematic setup of the experiment described in Example 2.
Figure 2A:
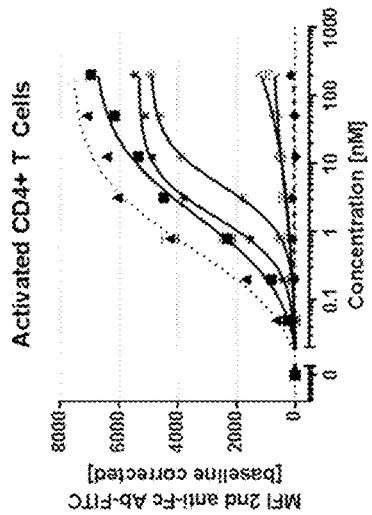
FIGS. 2A, 2B, 2C and 2D show the binding of anti-OX40 antibodies to activated human CD4$^+$ and CD8$^+$ T cells. OX40 is not expressed on resting human PBMCs (FIGS. 2A and 2C). After activation of human PBMCs OX40 is up-regulated on CD4$^+$ and CD8$^+$ T cells (FIGS. 2B and 2D). OX40 expression on human CD8$^+$ T cells is lower than on CD4$^+$ T cells. The depicted clones varied in their binding strength (EC$_{50}$ values as well as signal strength) to OX40 positive cells. Shown is the binding as median of fluorescence intensity (MFI) of FITC labeled anti-human IgG Fcγ-specific goat IgG F(ab')2 fragment which is used as secondary detection antibody. MFI was measured by flow cytometry and baseline corrected by subtracting the MFI of the blank control. The x-axis shows the concentration of antibody constructs. All OX40 clones do bind to activated, OX40 expressing human CD4$^+$ T cells, and to a lower extent to activated human CD8$^+$ T cells.
Figure 2B:
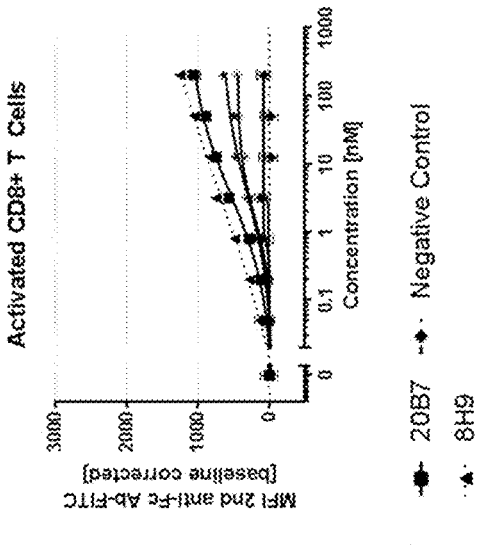
Figure 2C:
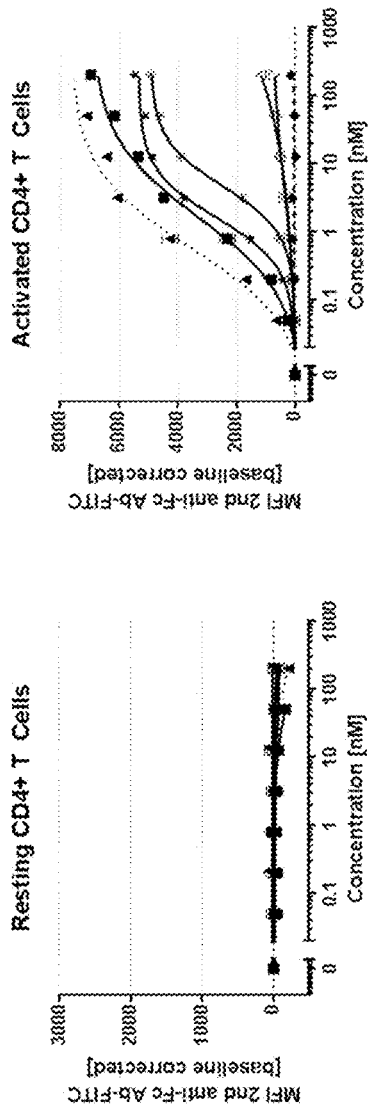
Figure 2D:
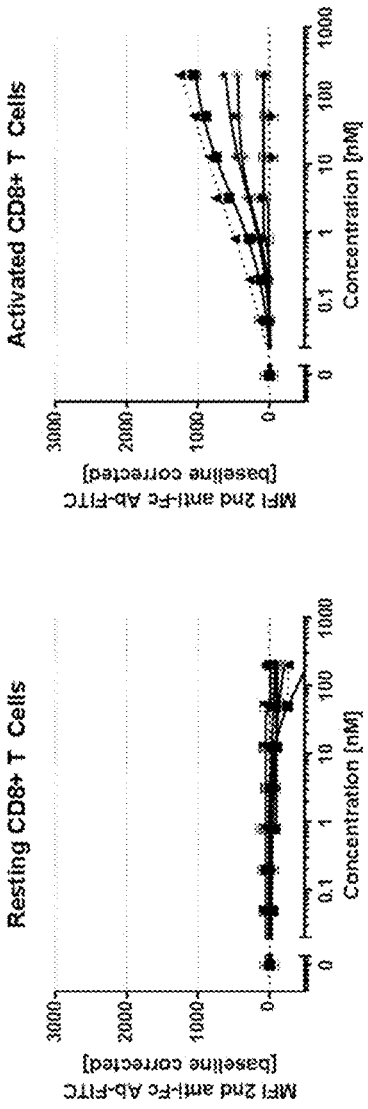

Generation of Ox40 Antibodies and Tool Binders 1.1 Preparation, Purification and Characterization of Antigens and Screening Tools for the Generation of Novel OX40 Binders by Phage Display DNA sequences encoding the ectodomains of human, mouse or cynomolgus OX40 (Table 1) were subcloned in frame with the human IgG1 heavy chain CH2 and CH3 domains on the knob (Merchant et al., 1998). An AcTEV protease cleavage site was introduced between an antigen ectodomain and the Fc of human IgG1. An Avi tag for directed biotinylation was introduced at the C-terminus of the antigen-Fc knob. Combination of the antigen-Fc knob chain containing the S354C/T366W mutations, with a Fc hole chain containing the Y349C/T366S/L368A/Y407V mutations allows generation of a heterodimer which includes a single copy of the OX40 ectodomain containing chain, thus creating a monomeric form of Fc-linked antigen (FIG. 1A). Table 1 shows the amino acid sequences of the various OX40 ectodomains. Table 2 the cDNA and amino acid sequences of monomeric antigen Fc(kih) fusion molecules as depicted in FIGS. 1A, 1B and 1C.

TABLE 1

Amino acid numbering of antigen ectodomains (ECD) and their origin

| SEQ ID NO: | Construct | Origin | ECD |
|---|---|---|---|
| 1 | human OX40 ECD | Synthetized according to P43489 | aa 29-214 |
| 122 | cynomolgus OX40 ECD | Isolated from cynomolgus blood | aa 29-214 |
| 123 | murine OX40 ECD | Synthetized according to P47741 | aa 10-211 |

TABLE 2 cDNA and amino acid sequences of monomeric antigen Fc(kih) fusion molecules (produced by combination of one Fc hole chain with one antigen Fc knob chain)

| SEQ ID NO: | Antigen | Sequence |
|---|---|---|
| 124 | Nucleotide sequence Fc hole chain | GACAAAACTCACACATGCCCACCGTGCCCAGCACCTGAA CTCCTGGGGGGACCGTCAGTCTTCCTCTTCCCCCCAAAAC CCAAGGACACCCTCATGATCTCCCGGACCCCTGAGGTCAC ATGCGTGGTGGTGGACGTGAGCCACGAAGACCCTGAGGT CAAGTTCAACTGGTACGTGGACGGCGTGGAGGTGCATAA TGCCAAGACAAAGCCGCGGGAGGAGCAGTACAACAGCAC GTACCGTGTGGTCAGCGTCCTCACCGTCCTGCACCAGGAC TGGCTGAATGGCAAGGAGTACAAGTGCAAGGTCTCCAAC AAAGCCCTCCCAGCCCCCATCGAGAAAACCATCTCCAAA GCCAAAGGGCAGCCCCGAGAACCACAGGTGTGCACCCTG CCCCCATCCCGGGATGAGCTGACCAAGAACCAGGTCAGC CTCTCGTGCGCAGTCAAAGGCTTCTATCCCAGCGACATCG CCGTGGAGTGGGAGAGCAATGGGCAGCCGGAGAACAACT ACAAGACCACGCCTCCCGTGCTGGACTCCGACGGCTCCTT CTTCCTCGTGAGCAAGCTCACCGTGGACAAGAGCAGGTG GCAGCAGGGGAACGTCTTCTCATGCTCCGTGATGCATGAG GCTCTGCACAACCACTACACGCAGAAGAGCCTCTCCCTGT CTCCGGGTAAA |
| 125 | Nucleotide sequence human OX40 antigen Fc knob chain | CTGCACTGCGTGGGCGACACCTACCCCAGCAACGACCGG TGCTGCCACGAGTGCAGACCCGGCAACGGCATGGTGTCC CGGTGCAGCCGGTCCCAGAACACCGTGTGCAGACCTTGC GGCCCTGGCTTCTACAACGACGTGGTGTCCAGCAAGCCCT GCAAGCCTTGTACCTGGTGCAACCTGCGGAGCGGCAGCG AGCGGAAGCAGCTGTGTACCGCCACCCAGGATACCGTGT GCCGGTGTAGAGCCGGCACCCAGCCCCTGGACAGCTACA AACCCGGCGTGGACTGCGCCCCTTGCCCTCCTGGCCACTT CAGCCCTGGCGACAACCAGGCCTGCAAGCCTTGGACCAA CTGCACCCTGGCCGGCAAGCACACCCTGCAGCCCGCCAG CAATAGCAGCGACGCCATCTGCGAGGACCGGGATCCTCC TGCCACCCAGCCTCAGGAAACCCAGGGCCCTCCCGCCAG ACCCATCACCGTGCAGCCTACAGAGGGCTGGCCCAGAAC CAGCCAGGGGCCTAGCACCAGACCCGTGGAAGTGCCTGG CGGCAGAGCCGTCGACGAACAGTTATATTTTCAGGGCGG CTCACCCAAATCTGCAGACAAAACTCACACATGCCCACC GTGCCCAGCACCTGAACTCCTGGGGGGACCGTCAGTCTTC CTCTTCCCCCCAAAACCCAAGGACACCCTCATGATCTCCC GGACCCCTGAGGTCACATGCGTGGTGGTGGACGTGAGCC ACGAAGACCCTGAGGTCAAGTTCAACTGGTACGTGGACG GCGTGGAGGTGCATAATGCCAAGACAAAGCCGCGGGAGG AGCAGTACAACAGCACGTACCGTGTGGTCAGCGTCCTCA CCGTCCTGCACCAGGACTGGCTGAATGGCAAGGAGTACA AGTGCAAGGTCTCCAACAAAGCCCTCCCAGCCCCCATCG AGAAAACCATCTCCAAAGCCAAAGGGCAGCCCCGAGAAC CACAGGTGTACACCCTGCCCCCATGCCGGGATGAGCTGA CCAAGAACCAGGTCAGCCTGTGGTGCCTGGTCAAAGGCT TCTATCCCAGCGACATCGCCGTGGAGTGGGAGAGCAATG GCAGCCGGAGAACAACTACAAGACCACGCCTCCCGTGC TGGACTCCGACGGCTCCTTCTTCCTCTACAGCAAGCTCAC CGTGGACAAGAGCAGGTGGCAGCAGGGGAACGTCTTCTC ATGCTCCGTGATGCATGAGGCTCTGCACAACCACTACACG CAGAAGAGCCTCTCCCTGTCTCCGGGTAAATCCGGAGGCC TGAACGACATCTTCGAGGCCCAGAAGATTGAATGGCACG AG |
| 126 | Nucleotide sequence cynomolgus OX40 antigen Fc knob chain | CTCCACTGTGTCGGGGACACCTACCCCAGCAACGACCGGT GCTGTCAGGAGTGCAGGCCAGGCAACGGGATGGTGAGCC GCTGCAACCGCTCCCAGAACACGGTGTGCCGTCCGTGCG GGCCCGGCTTCTACAACGACGTGGTCAGCGCCAAGCCCT GCAAGGCCTGCACATGGTGCAACCTCAGAAGTGGGAGTG AGCGGAAACAGCCGTGCACGGCCACACAGGACACAGTCT GCCGCTGCCGGGCGGGCACCCAGCCCCTGGACAGCTACA AGCCTGGAGTTGACTGTGCCCCCTGCCCTCCAGGGCACTT CTCCCCGGGCGACAACCAGGCCTGCAAGCCCTGGACCAA CTGCACCTTGGCCGGGAAGCACACCCTGCAGCCAGCCAG CAATAGCTCGGACGCCATCTGTGAGGACAGGGACCCCCC ACCCACAGCCCCAGGAGACCCAGGGCCCCCGGCCAG GCCCACCACTGTCCAGCCCACTGAAGCCTGGCCCAGAAC CTCACAGAGACCCTCCACCCGGCCCGTGGAGGTCCCGG GGGCCCTGCGGTCGACGAACAGTTATATTTTCAGGGCGGC TCACCCAAATCTGCAGACAAAACTCACACATGCCCACCGT GCCCAGCACCTGAACTCCTGGGGGGACCGTCAGTCTTCCT CTTCCCCCCAAAACCCAAGGACACCCTCATGATCTCCCGG ACCCCTGAGGTCACATGCGTGGTGGTGGACGTGAGCCAC |

TABLE 2-continued cDNA and amino acid sequences of monomeric antigen
Fc(kih) fusion molecules (produced by combination of
one Fc hole chain with one antigen Fc knob chain)

| SEQ ID NO: | Antigen | Sequence |
|---|---|---|
| | | GAAGACCCTGAGGTCAAGTTCAACTGGTACGTGGACGGC<br>GTGGAGGTGCATAATGCCAAGACAAAGCCGCGGGAGGAG<br>CAGTACAACAGCACGTACCGTGTGGTCAGCGTCCTCACCG<br>TCCTGCACCAGGACTGGCTGAATGGCAAGGAGTACAAGT<br>GCAAGGTCTCCAACAAAGCCCTCCCAGCCCCCATCGAGA<br>AAACCATCTCCAAAGCCAAAGGGCAGCCCCGAGAACCAC<br>AGGTGTACACCCTGCCCCCATGCCGGGATGAGCTGACCA<br>AGAACCAGGTCAGCCTGTGGTGCCTGGTCAAAGGCTTCTA<br>TCCCAGCGACATCGCCGTGGAGTGGGAGAGCAATGGGCA<br>GCCGGAGAACAACTACAAGACCACGCCTCCCGTGCTGGA<br>CTCCGACGGCTCCTTCTTCCTCTACAGCAAGCTCACCGTG<br>GACAAGAGCAGGTGGCAGCAGGGGAACGTCTTCTCATGC<br>TCCGTGATGCATGAGGCTCTGCACAACCACTACACGCAG<br>AAGAGCCTCTCCCTGTCTCCGGGTAAATCCGGAGGCCTGA<br>ACGACATCTTCGAGGCCCAGAAGATTGAATGGCACGAG |
| 127 | Nucleotide sequence murine OX40 antigen Fc knob chain | GTGACCGCCAGACGGCTGAACTGCGTGAAGCACACCTAC<br>CCCAGCGGCCACAAGTGCTGCAGAGAGTGCCAGCCCGGC<br>CACGGCATGGTGTCCAGATGCGACCACACACGGGACACC<br>CTGTGCCACCCTTGCGAGACAGGCTTCTACAACGAGCCG<br>TGAACTACGATACCTGCAAGCAGTGCACCCAGTGCAACC<br>ACAGAAGCGGCAGCGAGCTGAAGCAGAACTGCACCCCCA<br>CC CAGGATACCGTGTGCAGATGCAGACCCGGCACCCAGC<br>CCAGACAGGACAGCGGCTACAAGCTGGGCGTGGACTGCG<br>TGCCCTGCCCTCCTGGCCACTTCAGCCCCGGCAACAACCA<br>GGCCTGCAAGCCCTGGACCAACTGCACCCTGAGCGGCAA<br>GCAGACCAGACACCCCGCCAGCGACAGCCTGGATGCCGT<br>GTGCGAGGACAGAAGCCTGCTGGCCACCCTGCTGTGGGA<br>GACACAGCGGCCCACCTTCAGACCCACCACCGTGCAGAG<br>CACCACCGTGTGGCCCAGAACCAGCGAGCTGCCCAGTCC<br>TCCTACCCTCGTGACACCTGAGGGCCCCGTCGACGAACAG<br>TTATATTTTCAGGGCGGCTCACCCAAATCTGCAGACAAAA<br>CTCACACATGCCCACCGTGCCCAGCACCTGAACTCCTGGG<br>GGGACCGTCAGTCTTCCTCTTCCCCCCAAAACCCAAGGAC<br>ACCCTCATGATCTCCCGGACCCCTGAGGTCACATGCGTGG<br>TGGTGGACGTGAGCCACGAAGACCCTGAGGTCAAGTTCA<br>ACTGGTACGTGGACGGCGTGGAGGTGCATAATGCCAAGA<br>CAAAGCCGCGGGAGGAGCAGTACAACAGCACGTACCGTG<br>TGGTCAGCGTCCTCACCGTCCTGCACCAGGACTGGCTGAA<br>TGGCAAGGAGTACAAGTGCAAGGTCTCCAACAAAGCCCT<br>CCCAGCCCCCATCGAGAAAACCATCTCCAAAGCCAAAGG<br>GCAGCCCCGAGAACCACAGGTGTACACCCTGCCCCCATG<br>CCGGGATGAGCTGACCAAGAACCAGGTCAGCCTGTGGTG<br>CCTGGTCAAAGGCTTCTATCCCAGCGACATCGCCGTGGAG<br>TGGGAGAGCAATGGGCAGCCGGAGAACAACTACAAGACC<br>ACGCCTCCCGTGCTGGACTCCGACGGCTCCTTCTTCCTCT<br>ACAGCAAGCTCACCGTGGACAAGAGCAGGTGGCAGCAGG<br>GGAACGTCTTCTCATGCTCCGTGATGCATGAGGCTCTGCA<br>CAACCACTACACGCAGAAGAGCCTCTCCCTGTCTCCGGGT<br>AAATCCGGAGGCCTGAACGACATCTTCGAGGCCCAGAAG<br>ATTGAATGGCACGAG |
| 128 | Fc hole chain | DKTHTCPPCPAPELLGGPSVFLFPPKPKDTLMISRTPEVTCVV<br>VDVSHEDPEVKFNWYVDGVEVHNAKTKPREEQYNSTYRV<br>VSVLTVLHQDWLNGKEYKCKVSNKALPAPIEKTISKAKGQP<br>REPQVCTLPPSRDELTKNQVSLSCAVKGFYPSDIAVEWESNG<br>QPENNYKTTPPVLDSDGSFFLVSKLTVDKSRWQQGNVFSCS<br>VMHEALHNHYTQKSLSLSPGK |
| 129 | human OX40 antigen Fc knob chain | LHCVGDTYPSNDRCCHECRPGNGMVSRCSRSQNTVCRPCGP<br>GFYNDVVSSKPCKPCTWCNLRSGSERKQLCTATQDTVCRCR<br>AGTQPLDSYKPGVDCAPCPPGHFSPGDNQACKPWTNCTLA<br>GKHTLQPASNSSDAICEDRDPPATQPQETQGPPARPITVQPTE<br>AWPRTSQGPSTRPVEVPGGRAVDEQLYFQGGSPKSADKTHT<br>CPPCPAPELLGGPSVFLFPPKPKDTLMISRTPEVTCVVVDVSH<br>EDPEVKFNWYVDGVEVHNAKTKPREEQYNSTYRVVSVLTV<br>LHQDWLNGKEYKCKVSNKALPAPIEKTISKAKGQPREPQVY<br>TLPPCRDELTKNQVSLWCLVKGFYPSDIAVEWESNGQPENN<br>YKTTPPVLDSDGSFFLYSKLTVDKSRWQQGNVFSCSVMHEA<br>LHNHYTQKSLSLSPGKSGGLNDIFEAQKIEWHE |
| 130 | cynomolgus OX40 antigen Fc knob chain | LHCVGDTYPSNDRCCQECRPGNGMVSRCNRSQNTVCRPCG<br>PGFYNDVVSAKPCKACTWCNLRSGSERKQPCTATQDTVCR<br>CRAGTQPLDSYKPGVDCAPCPPGHFSPGDNQACKPWTNCTL |

TABLE 2-continued cDNA and amino acid sequences of monomeric antigen Fc(kih) fusion molecules (produced by combination of one Fc hole chain with one antigen Fc knob chain)

| SEQ ID NO: | Antigen | Sequence |
|---|---|---|
| | | AGKHTLQPASNSSDAICEDRDPPPTQPQETQGPPARPTTVQP<br>TEAWPRTSQRPSTRPVEVPRGPAVDEQLYFQGGSPKSADKT<br>HTCPPCPAPELLGGPSVFLFPPKPKDTLMISRTPEVTCVVVDV<br>SHEDPEVKFNWYVDGVEVHNAKTKPREEQYNSTYRVVSVL<br>TVLHQDWLNGKEYKCKVSNKALPAPIEKTISKAKGQPREPQ<br>VYTLPPCRDELTKNQVSLWCLVKGFYPSDIAVEWESNGQPE<br>NNYKTTPPVLDSDGSFFLYSKLTVDKSRWQQGNVFSCSVM<br>HEALHNHYTQKSLSLSPGKSGGLNDIFEAQKIEWHE |
| 131 | murine OX40 antigen Fc knob chain | VTARRLNCVKHTYPSGHKCCRECQPGHGMVSRCDHTRDTL<br>CHPCETGFYNEAVNYDTCKQCTQCNHRSGSELKQNCTPTQ<br>DTVCRCRPGTQPRQDSGYKLGVDCVPCPPGHFSPGNNQACK<br>PWTNCTLSGKQTRHPASDSLDAVCEDRSLLATLLWETQRPT<br>FRPTTVQSTTVWPRTSELPSPPTLVTPEGPVDEQLYFQGGSP<br>KSADKTHTCPPCPAPELLGGPSVFLFPPKPKDTLMISRTPEVT<br>CVVVDVSHEDPEVKFNWYVDGVEVHNAKTKPREEQYNST<br>YRVVSVLTVLHQDWLNGKEYKCKVSNKALPAPIEKTISKAK<br>GQPREPQVYTLPPCRDELTKNQVSLWCLVKGFYPSDIAVEW<br>ESNGQPENNYKTTPPVLDSDGSFFLYSKLTVDKSRWQQGNV<br>FSCSVMHEALHNHYTQKSLSLSPGKSGGLNDIFEAQKIEWHE |

All OX40-Fc-fusion encoding sequences were cloned into a plasmid vector driving expression of the insert from an MPSV promoter and containing a synthetic polyA signal sequence located at the 3' end of the CDS. In addition, the vector contained an EBV OriP sequence for episomal maintenance of the plasmid.

For preparation of the biotinylated monomeric antigen/Fc fusion molecules, exponentially growing suspension HEK293 EBNA cells were co-transfected with three vectors encoding the two components of fusion protein (knob and hole chains) as well as BirA, an enzyme necessary for the biotinylation reaction. The corresponding vectors were used at a 2:1:0.05 ratio ("antigen ECD-AcTEV-Fc knob":"Fc hole":"BirA").

For protein production in 500 ml shake flasks, 400 million HEK293 EBNA cells were seeded 24 hours before transfection. For transfection cells were centrifuged for 5 minutes at 210 g, and supernatant was replaced by pre-warmed CD CHO medium. Expression vectors were resuspended in 20 mL of CD CHO medium containing 200 µg of vector DNA. After addition of 540 µL of polyethylenimine (PEI), the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% $CO_2$ atmosphere. After the incubation, 160 mL of F17 medium was added and cells were cultured for 24 hours. One day after transfection, 1 mM valproic acid and 7% Feed were added to the culture. After 7 days of culturing, the cell supernatant was collected by spinning down cells for 15 min at 210 g. The solution was sterile filtered (0.22 µm filter), supplemented with sodium azide to a final concentration of 0.01% (w/v), and kept at 4° C.

Secreted proteins were purified from cell culture supernatants by affinity chromatography using Protein A, followed by size exclusion chromatography. For affinity chromatography, the supernatant was loaded on a HiTrap ProteinA HP column (CV=5 mL, GE Healthcare) equilibrated with 40 mL 20 mM sodium phosphate, 20 mM sodium citrate pH 7.5. Unbound protein was removed by washing with at least 10 column volumes of a buffer containing 20 mM sodium phosphate, 20 mM sodium citrate and 0.5 M sodium chloride (pH 7.5). The bound protein was eluted using a linear pH-gradient of sodium chloride (from 0 to 500 mM) created over 20 column volumes of 20 mM sodium citrate, 0.01% (v/v) Tween-20, pH 3.0. The column was then washed with 10 column volumes of a solution containing 20 mM sodium citrate, 500 mM sodium chloride and 0.01% (v/v) Tween-20, pH 3.0.

The pH of the collected fractions was adjusted by adding 1/40 (v/v) of 2M Tris, pH8.0. The protein was concentrated and filtered prior to loading on a HiLoad Superdex 200 column (GE Healthcare) equilibrated with 2 mM MOPS, 150 mM sodium chloride, 0.02% (w/v) sodium azide solution of pH 7.4.

1.2 Selection of Ox40-specific 8119, 20B7, 49B4, 1G4, CLC-563, CLC-564 and 17A9 Antibodies from Generic Fab and Common Light Chain Libraries Anti-OX40 antibodies were selected from three different generic phage display libraries: DP88-4 (clones 20B7, 8H9 1G4 and 49B4), the common light chain library Vk3_20/VH3_23 (clones CLC-563 and CLC-564) and lambda-DP47 (clone 17A9).

The DP88-4 library was constructed on the basis of human germline genes using the V-domain pairing Vk1_5 (kappa light chain) and VH1_69 (heavy chain) comprising randomized sequence space in CDR3 of the light chain (L3, 3 different lengths) and CDR3 of the heavy chain (H3, 3 different lengths). Library generation was performed by assembly of 3 PCR-amplified fragments applying splicing by overlapping extension (SOE) PCR. Fragment 1 comprises the 5' end of the antibody gene including randomized L3, fragment 2 is a central constant fragment spanning from L3 to H3 whereas fragment 3 comprises randomized H3 and the 3' portion of the antibody gene. The following primer combinations were used to generate these library fragments for DP88-4 library: fragment 1 (forward primer LMB3 combined with reverse primers Vk1_5_L3r_S or Vk1_5_L3r_SY or Vk1_5_L3r_SPY), fragment 2 (forward primer RJH31 combined with reverse primer RJH32) and fragment 3 (forward primers DP88-v4-4 or DP88-v4-6 or DP88-v4-8 combined with reverse primer fdseqlong), respectively. PCR parameters for production of library fragments were 5 min initial denaturation at 94° C., 25 cycles of 1 min 94° C., 1 min 58° C., 1 min 72° C. and terminal elongation for 10 min at 72° C. For assembly PCR, using equimolar ratios of the gel-purified single fragments as template, parameters were 3 min initial denaturation at 94° C. and 5 cycles of 30 s 94° C., 1 min 58° C., 2 min 72° C. At this stage, outer primers (LMB3 and fdseqlong) were added and additional 20 cycles were performed prior to a terminal elongation for 10 min at 72° C. After assembly of sufficient amounts of full length randomized Fab constructs, they were digested NcoI/NheI and ligated into similarly treated acceptor phagemid vector. Purified ligations were used for ~60 transformations into electrocompetent E. coli TG1. Phagemid particles displaying the Fab library were rescued and purified by PEG/NaCl purification to be used for selections. These library construction steps were repeated three times to obtain a final library size of 4.4×10⁹. Percentages of functional clones, as determined by C-terminal tag detection in dot blot, were 92.6% for the light chain and 93.7% for the heavy chain, respectively.

The common light chain library Vk3_20/VH3_23 was constructed on the basis of human germline genes using the V-domain pairing Vk3_20 (kappa light chain) and VH3_23 (heavy chain) comprising a constant non-randomized common light chain Vk3_20 and randomized sequence space in CDR3 of the heavy chain (H3, 3 different lengths). Library generation was performed by assembly of 2 PCR-amplified fragments applying splicing by overlapping extension (SOE) PCR. Fragment 1 is a constant fragment spanning from L3 to H3 whereas fragment 2 comprises randomized H3 and the 3' portion of the antibody gene. The following primer combinations were used to generate these library fragments for the Vk3_20/VH3_23 common light chain library: fragment 1 (forward primer MS64 combined with reverse primer DP47CDR3_ba (mod.)) and fragment 2 (forward primers DP47-v4-4, DP47-v4-6, DP47-v4-8 combined with reverse primer fdseqlong), respectively. PCR parameters for production of library fragments were 5 min initial denaturation at 94° C., 25 cycles of 1 min 94° C., 1 min 58° C., 1 min 72° C. and terminal elongation for 10 min at 72° C. For assembly PCR, using equimolar ratios of the gel-purified single fragments as template, parameters were 3 min initial denaturation at 94° C. and 5 cycles of 30 s 94° C., 1 min 58° C., 2 min 72° C. At this stage, outer primers (MS64 and fdseqlong) were added and additional 18 cycles were performed prior to a terminal elongation for 10 min at 72° C. After assembly of sufficient amounts of full length randomized VH constructs, they were digested MunI/NotI and ligated into similarly treated acceptor phagemid vector. Purified ligations were used for ~60 transformations into electrocompetent E. coli TG1. Phagemid particles displaying the Fab library were rescued and purified by PEG/NaCl purification to be used for selections. A final library size of 3.75×10⁹ was obtained. Percentages of functional clones, as determined by C-terminal tag detection in dot blot, were 98.9% for the light chain and 89.5% for the heavy chain, respectively.

The lambda-DP47 library was constructed on the basis of human germline genes using the following V-domain pairings: Vl3_19 lambda light chain with VH3_23 heavy chain. The library was randomized in CDR3 of the light chain (L3) and CDR3 of the heavy chain (H3) and was assembled from 3 fragments by "splicing by overlapping extension" (SOE) PCR. Fragment 1 comprises the 5' end of the antibody gene including randomized L3, fragment 2 is a central constant fragment spanning from the end of L3 to the beginning of H3 whereas fragment 3 comprises randomized H3 and the 3' portion of the Fab fragment. The following primer combinations were used to generate library fragments for library: fragment 1 (LMB3-Vl_3_19_L3r_V/Vl_3_19_L3r_HV/Vl_3_19_L3r_HLV), fragment 2 (RJH80-DP47CDR3_ba (mod)) and fragment 3 (DP47-v4-4/DP47-v4-6/DP47-v4-8-fdseqlong). PCR parameters for production of library fragments were 5 min initial denaturation at 94° C., 25 cycles of 60 sec at 94° C., 60 sec at 55° C., 60 sec at 72° C. and terminal elongation for 10 min at 72° C. For assembly PCR, using equimolar ratios of the 3 fragments as template, parameters were 3 min initial denaturation at 94° C. and 5 cycles of 60 sec at 94° C., 60 sec at 55° C., 120 sec at 72° C. At this stage, outer primers were added and additional 20 cycles were performed prior to a terminal elongation for 10 min at 72° C. After assembly of sufficient amounts of full length randomized Fab fragments, they were digested with NcoI/NheI alongside with similarly treated acceptor phagemid vector. 15 ug of Fab library insert were ligated with 13.3 ug of phagemid vector. Purified ligations were used for 60 transformations resulting in 1.5×10⁹ transformants. Phagemid particles displaying the Fab library were rescued and purified by PEG/NaCl purification to be used for selections.

Human OX40 (CD134) as antigen for the phage display selections was transiently expressed as N-terminal monomeric Fc-fusion in HEK EBNA cells and in vivo site-specifically biotinylated via co-expression of BirA biotin ligase at the avi-tag recognition sequence located a the C-terminus of the Fc portion carrying the receptor chain (Fc knob chain).

Selection rounds (biopanning) were performed in solution according to the following pattern:

1. Pre-clearing of ~1012 phagemid particles on maxisorp plates coated with 10 ug/ml of an unrelated human IgG to deplete the libraries of antibodies recognizing the Fc-portion of the antigen,
2. incubation of the non-binding phagemid particles with 100 nM biotinylated human OX40 for 0.5 h in the presence of 100 nM unrelated non-biotinylated Fc knob-into-hole construct for further depletion of Fc-binders in a total volume of 1 ml,
3. capture of biotinylated hu OX40 and attached specifically binding phage by transfer to 4 wells of a neutravidin pre-coated microtiter plate for 10 min (in rounds 1 & 3),
4. washing of respective wells using 5×PBS/Tween20 and 5×PBS,
5. elution of phage particles by addition of 250 ul 100 mM TEA (triethylamine) per well for 10 min and neutralization by addition of 500 ul 1M Tris/HCl pH 7.4 to the pooled eluates from 4 wells,
6. post-clearing of neutralized eluates by incubation on neutravidin pre-coated microtiter plate with 100 nM biotin-captured Fc knob-into-hole construct for final removal of Fc-binders,
7. re-infection of log-phase E. coli TG1 cells with the supernatant of eluted phage particles, infection with helperphage VCSM13, incubation on a shaker at 30° C. over night and subsequent PEG/NaCl precipitation of phagemid particles to be used in the next selection round.

Selections were carried out over 3 or 4 rounds using constant antigen concentrations of 100 nM. In order to increase the likelihood for binders that are cross-reactive not only to cynomolgus OX40 but also murine OX40, in some selection rounds the murine target was used instead of the human OX40. In rounds 2 and 4, in order to avoid enrichment of binders to neutravidin, capture of antigen:phage complexes was performed by addition of 5.4×107 streptavidin-coated magnetic beads. Specific binders were identified by ELISA as follows: 100 ul of 25 nM biotinylated human OX40 and 10 ug/ml of human IgG were coated on neutravidin plates and maxisorp plates, respectively. Fab-containing bacterial supernatants were added and binding Fabs were detected via their Flag-tags using an anti-Flag/HRP secondary antibody. Clones exhibiting signals on human OX40 and being negative on human IgG were short-listed for further analyses and were also tested in a similar fashion against cynomolgus and murine OX40. They were bacterially expressed in a 0.5 liter culture volume, affinity purified and further characterized by SPR-analysis using BioRad's ProteOn XPR36 biosensor.

Table 3 shows the sequence of generic phage-displayed antibody library (DP88-4), Table 4 provides cDNA and amino acid sequences of library DP88-4 germline template and Table 5 shows the Primer sequences used for generation of DP88-4 germline template.

TABLE 3

Sequence of generic phage-displayed antibody library (DP88-4)

| SEQ ID NO: | Description | Sequence |
|---|---|---|
| 132 | nucleotide sequence of pRJH33 library template DP88-4 library; complete Fab coding region comprising PelB leader sequence + Vk1_5 kappa V-domain + CL constant domain for light chain and PelB + VH1_69 V-domain + CH1 constant domain for heavy chain including tags | TGAAATACCTATTGCCTACGGCAGCCGCTGGATTGTTATTACTCG CGGCCCAGCCGGCCATGGCCGACATCCAGATGACCCAGTCTCCT TCCACCCTGTCTGCATCTGTAGGAGACCGTGTCACCATCACTTGC CGTGCCAGTCAGAGTATTAGTAGCTGGTTGGCCTGGTATCAGCA GAAACCAGGGAAAGCCCCTAAGCTCCTGATCTATGATGCCTCCA GTTTGGAAAGTGGGGTCCCATCACGTTTCAGCGGCAGTGGATCC GGGACAGAATTCACTCTCACCATCAGCAGCTTGCAGCCTGATGA TTTTGCAACTTATTACTGCCAACAGTATAATAGTTATTCTACGTT TGGCCAGGGCACCAAAGTCGAGATCAAGCGTACGGTGGCTGCA CCATCTGTCTTCATCTTCCCGCCATCTGATGAGCAGTTGAAATCT GGAACTGCCTCTGTTGTGTGCCTGCTGAATAACTTCTATCCCAGA GTAACTCCCAGGAGAGTGTCACAGAGCAGGACAGCAAGGACAG CACCTACAGCCTCAGCAGCACCCTGACGCTGAGCAAAGCAGACT ACGAGAAACACAAAGTCTACGCCTGCGAAGTCACCCATCAGGG CCTGAGCTCGCCCGTCACAAAGAGCTTCAACAGGGGAGAGTGTG GAGCCGCAGAACAAAAACTCATCTCAGAAGAGGATCTGAATGG AGCCGCAGACTACAAGGACGACGACGACAAGGGTGCCGCATAA TAAGGCGCGCCAATTCTATTTCAAGGAGACAGTCATATGAAATA CCTGCTGCCGACCGCTGCTGCTGGTCTGCTGCTCCTCGCTGCCCA GCCGGCGATGGCCCAGGTGCAATTGGTGCAGTCTGGGGCTGAGG TGAAGAAGCCTGGGTCCTCGGTGAAGGTCTCCTGCAAGGCCTCC GGAGGCACATTCAGCAGCTACGCTATAAGCTGGGTGCGACAGGC CCCTGGACAAGGGCTCGAGTGGATGGGAGGGATCATCCCTATCT TTGGTACAGCAAACTACGCACAGAAGTTCCAGGGCAGGGTCACC ATTACTGCAGACAAATCCACGAGCACAGCCTACATGGAGCTGAG CAGCCTGAGATCTGAGGACACCGCCGTGTATTACTGTGCGAGAC TATCCCCAGGCGGTTACTATGTTATGGATGCCTGGGGCCAAGGG ACCACCGTGACCGTCTCCTCAGCTAGCACCAAAGGCCCATCGGT CTTCCCCCTGGCACCCTCCTCCAAGAGCACCTCTGGGGGCACAG CGGCCCTGGGCTGCCTGGTCAAGGACTACTTCCCCGAACCGGTG ACGGTGTCGTGGAACTCAGGCGCCCTGACCAGCGGCGTGCACAC CTTCCCGGCTGTCCTACAGTCCTCAGGACTCTACTCCCTCAGCAG CGTGGTGACCGTGCCCTCCAGCAGCTTGGGCACCCAGACCTACA TCTGCAACGTGAATCACAAGCCCAGCAACACCAAAGTGGACAA GAAAGTTGAGCCCAAATCTTGTGACGCGGCCGCAAGCACTAGTG CCCATCACCATCACCATCACGCCGCGGCA |

TABLE 4 cDNA and amino acid sequences of library DP88-4 germline template

| SEQ ID NO: | Description | Sequence |
|---|---|---|
| 133 | nucleotide sequence of Fab light chain Vk1_5 | GACATCCAGATGACCCAGTCTCCTTCCACCCTGTCTGC ATCTGTAGGAGACCGTGTCACCATCACTTGCCGTGCCA GTCAGAGTATTAGTAGCTGGTTGGCCTGGTATCAGCAG AAACCAGGGAAAGCCCCTAAGCTCCTGATCTATGATGC CTCCAGTTTGGAAAGTGGGGTCCCATCACGTTTCAGCG GCAGTGGATCCGGGACAGAATTCACTCTCACCATCAGC AGCTTGCAGCCTGATGATTTTGCAACTTATTACTGCCA ACAGTATAATAGTTATTCTACGTTTGGCCAGGGCACCA AAGTCGAGATCAAGCGTACGGTGGCTGCACCATCTGTC TTCATCTTCCCGCCATCTGATGAGCAGTTGAAATCTGG AACTGCCTCTGTTGTGTGCCTGCTGAATAACTTCTATCC CAGAGAGGCCAAAGTACAGTGGAAGGTGGATAACGCC CTCCAATCGGGTAACTCCCAGGAGAGTGTCACAGAGC AGGACAGCAAGGACAGCACCTACAGCCTCAGCAGCAC |

TABLE 4-continued cDNA and amino acid sequences of library DP88-4 germline template

| SEQ ID NO: | Description | Sequence |
|---|---|---|
| | | CCTGACGCTGAGCAAAGCAGACTACGAGAAACACAAA GTCTACGCCTGCGAAGTCACCCATCAGGGCCTGAGCTC GCCCGTCACAAAGAGCTTCAACAGGGGAGAGTGTGGA GCCGCAGAACAAAAACTCATCTCAGAAGAGGATCTGA ATGGAGCCGCAGACTACAAGGACGACGACGACAAGGG TGCCGCA |
| 134 | Fab light chain Vk1_5 | DIQMTQSPSTLSASVGDRVTITCRASQSISSWLAWYQQKP GKAPKLLIYDASSLESGVPSRFSGSGSGTEFTLTISSLQPDD FATYYCQQYNSYSTFGQGTKVEIKRTVAAPSVFIFPPSDE QLKSGTASVVCLLNNFYPREAKVQWKVDNALQSGNSQE SVTEQDSKDSTYSLSSTLTLSKADYEKHKVYACEVTHQG LSSPVTKSFNRGECGAAEQKLISEEDLNGAADYKDDDDK GAA |
| 135 | nucleotide sequence of Fab heavy chain VH1_69 | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTCGAGTGGATGGGAGG GATCATCCCTATCTTTGGTACAGCAAACTACGCACAGA AGTTCCAGGGCAGGGTCACCATTACTGCAGACAAATCC ACGAGCACAGCCTACATGGAGCTGAGCAGCCTGAGAT CTGAGGACACCGCCGTGTATTACTGTGCGAGACTATCC CCAGGCGGTTACTATGTTATGGATGCCTGGGGCCAAGG GACCACCGTGACCGTCTCCTCAGCTAGCACCAAAGGCC CATCGGTCTTCCCCCTGGCACCCTCCTCCAAGAGCACC TCTGGGGGCACAGCGGCCCTGGGCTGCCTGGTCAAGG ACTACTTCCCCGAACCGGTGACGGTGTCGTGGAACTCA GGCGCCCTGACCAGCGGCGTGCACACCTTCCCGGCTGT CCTACAGTCCTCAGGACTCTACTCCCTCAGCAGCGTGG TGACCGTGCCCTCCAGCAGCTTGGGCACCCAGACCTAC ATCTGCAACGTGAATCACAAGCCCAGCAACACCAAAG TGGACAAGAAAGTTGAGCCCAAATCTTGTGACGCGGC CGCAAGCACTAGTGCCCATCACCATCACCATCACGCCG CGGCA |
| 136 | Fab heavy chain VH1_69 | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCARLSPGGYYVMDAWGQGTTVT VSSASTKGPSVFPLAPSSKSTSGGTAALGCLVKDYFPEPV TVSWNSGALTSGVHTFPAVLQSSGLYSLSSVVTVPSSSLG TQTYICNVNHKPSNTKVDKKVEPKSCDAAASTSAHHHH HHAAA |

TABLE 5

Primer sequences used for generation of DP88-4 library

| SEQ ID NO: | Primer name | Primer sequence 5'-3' |
|---|---|---|
| 137 | LMB3 | CAGGAAACAGCTATGACCATGATTAC |
| 138 | Vk1_5_L3r_S | CTCGACTTTGGTGCCCTGGCCAAACGTS<u>BA</u>A<u>TA</u> <u>C</u>GA<u>AT</u>T<u>ATA</u>CTGTTGGCAGTAATAAGTTGCAAAATCAT underlined: 60% original base and 40% randomization as M. bolded and italic: 60% original base and 40% randomization as N |
| 139 | Vk1_5_L3r_SY | CTCGACTTTGGTGCCCTGGCCAAACGTMHRSGRATACGA A<u>TT</u>ATACTGTTGGCAGTAATAAGTTGCAAAATCAT underlined: 60% original base and 40% randomization as M. bolded and italic: 60% original base and 40% randomization as N |
| 140 | Vk1_5_L3r_SPY | CTCGACTTTGGTGCCCTGGCCAAACGTMHH<u>M</u>SS<u>S</u>GRATA <u>C</u>GA<u>AT</u>T<u>ATA</u>CTGTTGGCAGTAATAAGTTGCAAAATCAT underlined: 60% original base and 40% randomization as M. bolded and italic: 60% original base and 40% randomization as N |
| 141 | RJH31 | ACGTTTGGCCAGGGCACCAAAGTCGAG |
| 142 | RJH32 | TCTCGCACAGTAATACACGGCGGTGTCC |

TABLE 5-continued

Primer sequences used for generation of DP88-4 library

| SEQ ID NO: | Primer name | Primer sequence 5'-3' |
|---|---|---|
| 143 | DP88-v4-4 | GGACACCGCCGTGTATTACTGTGCGAGA-1-2-2-3-4-GAC-TAC-TGGGGCCAAGGGACCACCGTGACCGTCTCC<br>1: G/D = 20%, E/V/S = 10%, A/P/R/L/T/Y = 5%; 2: G/Y/S = 15%, A/D/T/R/P/L/V/N/W/F/I/E = 4.6%; 3: G/A/Y = 20%, P/W/S/D/T = 8%; 4: F = 46%, L/M = 15%, G/I/Y = 8%. |
| 144 | DP88-v4-6 | GGACACCGCCGTGTATTACTGTGCGAGA-1-2-2-2-3-4-GAC-TAC-TGGGGCCAAGGGACCACCGTGACCGTCTCC<br>1: G/D = 20%, E/V/S = 10%, A/P/R/L/T/Y = 5%; 2: G/Y/S = 15%, A/D/T/R/P/L/V/N/W/F/I/E = 4.6%; 3: G/A/Y = 20%, P/W/S/D/T = 8%; 4: F = 46%, L/M = 15%, G/I/Y = 8%. |
| 145 | DP 88-v4-8 | GGACACCGCCGTGTATTACTGTGCGAGA-1-2-2-2-2-2-3-4-GAC-TAC-TGGGGCCAAGGGACCACCGTGACCGTCTCC<br>1: G/D = 20%, E/V/S = 10%, A/P/R/L/T/Y = 5%; 2: G/Y/S = 15%, A/D/T/R/P/L/V/N/W/F/I/E = 4.6%; 3: G/A/Y = 20%, P/W/S/D/T = 8%; 4: F = 46%, L/M = 15%, G/I/Y = 8%. |
| 146 | fdseqlong | GACGTTAGTAAATGAATTTTCTGTATGAGG |

Table 6 shows the sequence of generic phage-displayed antibody common light chain library (Vk3_20/VH3_23). Table 7 provides cDNA and amino acid sequences of common light chain library (Vk3_20/VH3_23) germline template and Table 8 shows the Primer sequences used for generation of common light chain library (Vk3_20/VH3_23).

TABLE 6

Sequence of generic phage-displayed antibody common light chain library (Vk3_20/VH3_23) template used for PCR

| SEQ ID NO: | Description | Sequence |
|---|---|---|
| 147 | pRJH110 library template of common light chain library Vk3_20/VH3_23; complete Fab coding region comprising PelB leader sequence + Vk3_20 kappa V-domain + CL constant domain for light chain and PelB + VH3_23 V-domain + CH1 constant domain for heavy chain including tags | ATGAAATACCTATTGCCTACGGCAGCCGCTGGATTGTTATTACTC<br>GCGGCCCAGCCGGCCATGGCCGAAATCGTGTTAACGCAGTCTCC<br>AGGCACCCTGTCTTTGTCTCCAGGGGAAAGAGCCACCCTCTCTT<br>GCAGGGCCAGTCAGAGTGTTAGCAGCAGCTACTTAGCCTGGTAC<br>CAGCAGAAACCTGGCCAGGCTCCCAGGCTCCTCATCTATGGAGC<br>ATCCAGCAGGGCCACTGGCATCCCAGACAGGTTCAGTGGCAGTG<br>GATCCGGGACAGACTTCACTCTCACCATCAGCAGACTGGAGCCT<br>GAAGATTTTGCAGTGTATTACTGTCAGCAGTATGGTAGCTCACC<br>GCTGACGTTCGGCCAGGGGACCAAAGTGGAAATCAAACGTACG<br>GTGGCTGCACCATCTGTCTTCATCTTCCCGCCATCTGATGAGCAG<br>TTGAAATCTGGAACTGCCTCTGTTGTGTGCCTGCTGAATAACTTC<br>TATCCCAGAGAGGCCAAAGTACAGTGGAAGGTGGATAACGCCC<br>TCCAATCGGGTAACTCCCAGGAGAGTGTCACAGAGCAGGACAG<br>CAAGGACAGCACCTACAGCCTCAGCAGCACCCTGACGCTGAGC<br>AAAGCAGACTACGAGAAACACAAAGTCTACGCCTGCGAAGTCA<br>CCCATCAGGGCCTGAGCTCGCCCGTCACAAAGAGCTTCAACAGG<br>GGAGAGTGTGGAGCCGCACATCACCATCACCATCACGGAGCCG<br>CAGACTACAAGGACGACGACGACAAGGGTGCCGCATAATAAGG<br>CGCGCCAATTCTATTTCAAGGAGACAGTCATATGAAATACCTGC<br>TGCCGACCGCTGCTGCTGGTCTGCTGCTCCTCGCTGCCCAGCCGG<br>CGATGGCCGAGGTGCAATTGCTGGAGTCTGGGGGAGGCTTGGTA<br>CAGCCTGGGGGGTCCCTGAGACTCTCCTGTGCAGCCTCCGGATT<br>CACCTTTAGCAGTTATGCCATGAGCTGGGTCCGCCAGGCTCCAG<br>GGAAGGGGCTGGAGTGGGTCTCAGCTATTAGTGGTAGTGGTGGT<br>AGCACATACTACGCAGACTCCGTGAAGGGCCGGTTCACCATCTC<br>CAGAGACAATTCCAAGAACACGCTGTATCTGCAGATGAACAGCC<br>TGAGAGCCGAGGACACGGCCGTATATTACTGTGCGAAACCGTTT<br>CCGTATTTTGACTACTGGGGCCAAGGAACCCTGGTCACCGTCTC<br>GAGTGCTAGCACCAAAGGCCCATCGGTCTTCCCCCTGGCACCCT<br>CCTCCAAGAGCACCTCTGGGGGCACAGCGGCCCTGGGCTGCCTG<br>GTCAAGGACTACTTCCCCGAACCGGTGACGGTGTCGTGGAACTC<br>AGGCGCCCTGACCAGCGGCGTGCACACCTTCCCGGCTGTCCTAC<br>AGTCCTCAGGACTCTACTCCCTCAGCAGCGTGGTGACCGTGCCC<br>TCCAGCAGCTTGGGCACCCAGACCTACATCTGCAACGTGAATCA |

TABLE 6-continued

Sequence of generic phage-displayed antibody common light
chain library (Vk3_20/VH3_23) template used for PCR

| SEQ ID NO: | Description | Sequence |
|---|---|---|
| | | CAAGCCCAGCAACACCAAAGTGGACAAGAAAGTTGAGCCCAAA TCTTGTGACGCGGCCGCAGAACAAAAACTCATCTCAGAAGAGGA TCTGAATGCCGCGGCA |

TABLE 7 cDNA and amino acid sequences of common light chain
library (Vk3_20/VH3_23) germline template

| SEQ ID NO: | Description | Sequence |
|---|---|---|
| 148 | nucleotide sequence of Fab light chain Vk3_20 | GAAATCGTGTTAACGCAGTCTCCAGGCACCCTGTCTTTGT CTCCAGGGGAAAGAGCCACCCTCTCTTGCAGGGCCAGTC AGAGTGTTAGCAGCAGCTACTTAGCCTGGTACCAGCAGA AACCTGGCCAGGCTCCCAGGCTCCTCATCTATGGAGCATC CAGCAGGGCCACTGGCATCCCAGACAGGTTCAGTGGCAG TGGATCCGGGACAGACTTCACTCTCACCATCAGCAGACTG GAGCCTGAAGATTTTGCAGTGTATTACTGTCAGCAGTATG GTAGCTCACCGCTGACGTTCGGCCAGGGGACCAAAGTGG AAATCAAACGTACGGTGGCTGCACCATCTGTCTTCATCTT CCCGCCATCTGATGAGCAGTTGAAATCTGGAACTGCCTCT GTTGTGTGCCTGCTGAATAACTTCTATCCCAGAGAGGCCA AAGTACAGTGGAAGGTGGATAACGCCCTCCAATCGGGTA ACTCCCAGGAGAGTGTCACAGAGCAGGACAGCAAGGACA GCACCTACAGCCTCAGCAGCACCCTGACGCTGAGCAAAG CAGACTACGAGAAACACAAAGTCTACGCCTGCGAAGTCA CCCATCAGGGCCTGAGCTCGCCCGTCACAAAGAGCTTCA ACAGGGGAGAGTGTGGAGCCGCACATCACCATCACCATC ACGGAGCCGCAGACTACAAGGACGACGACGACAAGGGT GCCGCA |
| 149 | Fab light chain Vk3_20 | EIVLTQSPGTLSLSPGERATLSCRASQSVSSSYLAWYQQKPG QAPRLLIYGASSRATGIPDRFSGSGSGTDFTLTISRLEPEDFAV YYCQQYGSSPLTFGQGTKVEIKRTVAAPSVFIFPPSDEQLKS GTASVVCLLNNFYPREAKVQWKVDNALQSGNSQESVTEQD SKDSTYSLSSTLTLSKADYEKHKVYACEVTHQGLSSPVTKSF NRGECGAAHHHHHHGAADYKDDDDKGAA |
| 150 | nucleotide sequence of Fab heavy chain VH3_23 | GAGGTGCAATTGCTGGAGTCTGGGGGAGGCTTGGTACAG CCTGGGGGGTCCCTGAGACTCTCCTGTGCAGCCTCCGGAT TCACCTTTAGCAGTTATGCCATGAGCTGGGTCCGCCAGGC TCCAGGGAAGGGGCTGGAGTGGGTCTCAGCTATTAGTGG TAGTGGTGGTAGCACATACTACGCAGACTCCGTGAAGGG CCGGTTCACCATCTCCAGAGACAATTCCAAGAACACGCTG TATCTGCAGATGAACAGCCTGAGAGCCGAGGACACGGCC GTATATTACTGTGCGAAACCGTTTCCGTATTTTGACTACT GGGGCCAAGGAACCCTGGTCACCGTCTCGAGTGCTAGCA CCAAAGGCCCATCGGTCTTCCCCCTGGCACCCTCCTCCAA GAGCACCTCTGGGGGCACAGCGGCCCTGGGCTGCCTGGT CAAGGACTACTTCCCCGAACCGGTGACGGTGTCGTGGAA CTCAGGCGCCCTGACCAGCGGCGTGCACACCTTCCCGGCT GTCCTACAGTCCTCAGGACTCTACTCCCTCAGCAGCGTGG TGACCGTGCCCTCCAGCAGCTTGGGCACCCAGACCTACAT CTGCAACGTGAATCACAAGCCCAGCAACACCAAAGTGGA CAAGAAAGTTGAGCCCAAATCTTGTGACGCGGCCGCAGA ACAAAAACTCATCTCAGAAGAGGATCTGAATGCCGCGGCA |
| 151 | Fab heavy chain VH3_23 (DP47) | EVQLLESGGGLVQPGGSLRLSCAASGFTFSSYAMSWVRQAP GKGLEWVSAISGSGGSTYYADSVKGRFTISRDNSKNTLYLQ MNSLRAEDTAVYYCAKPFPYFDYWGQGTLVTVSSASTKGP SVFPLAPSSKSTSGGTAALGCLVKDYFPEPVTVSWNSGALTS GVHTFPAVLQSSGLYSLSSVVTVPSSSLGTQTYICNVNHKPS NTKVDKKVEPKSCDAAAEQKLISEEDLNAAA |

TABLE 8

Primer sequences used for generation of DP88-4 library

| SEQ ID NO | Primer name | Primer sequence 5'-3' |
|---|---|---|
| 152 | MS64 | ACGTTCGGCCAGGGGACCAAAGTGG |
| 153 | DP47CDR3_ba (mod.) | CGCACAGTAATATACGGCCGTGTCC |
| 154 | DP47-v4-4 | CGAGGACACGGCCGTATATTACTGTGCG-5-1-2-2-3-4-GAC-TAC-TGGGGCCAAGGAACCCTGGTCACCGTCTCG |
| 155 | DP47-v4-6 | CGAGGACACGGCCGTATATTACTGTGCG-5-1-2-2-2-2-3-4-GAC-TAC-TGGGGCCAAGGAACCCTGGTCACCGTCTCG |
| 156 | DP47-v4-8 | CGAGGACACGGCCGTATATTACTGTGCG-5-1-2-2-2-2-2-2-3-4-GAC-TAC-TGGGGCCAAGGAACCCTGGTCACCGTCTCG |
| 157 | fdseqlong | GACGTTAGTAAATGAATTTTCTGTATGAGG |

1: G/D = 20%, E/V/S = 10%, A/P/R/L/T/Y = 5%;
2: G/Y/S = 15%, A/D/T/R/P/L/V/N/W/F/I/E = 4.6%;
3: G/A/Y = 20%, P/W/S/D/T = 8%;
4: F = 46%, L/M = 15%, G/I/Y = 8%;
5: K = 70%, R = 30%.

Table 9 shows the sequence of generic phage-displayed lambda-DP47 library (Vl3_19/VH3_23) template used for PCRs. Table 10 provides cDNA and amino acid sequences of lambda-DP47 library (Vl3_19/VH3_23) germline template and Table 11 shows the Primer sequences used for generation of lambda-DP47 library (Vl3_19/VH3_23).

TABLE 9

Sequence of generic phage-displayed lambda-DP47 library (Vl3_19/VH3_23) template used for PCRs

| SEQ ID NO | Description | Sequence |
|---|---|---|
| 158 | pRJH53 library template of lambda-DP47 library Vl3_19/VH3_23; complete Fab coding region comprising PelB leader sequence + Vl3_19 lambda V-domain + CL constant domain for light chain and PelB + VH3_23 V-domain + CH1 constant domain for heavy chain including tags | ATGAAATACCTATTGCCTACGGCAGCCGCTGGATTGTTATTACTC GCGCCCAGCCGGCCATGGCCTCGTCTGAGCTGACTCAGGACCC TGCTGTGTCTGTGGCCTTGGGACAGACAGTCAGGATCACATGCC AAGGAGACAGCCTCAGAAGTTATTATGCAAGCTGGTACCAGCAG AAGCCAGGACAGGCCCCTGTACTTGTCATCTATGGTAAAAACAA CCGGCCCTCAGGGATCCCAGACCGATTCTCTGGCTCCAGCTCAG GAAACACAGCTTCCTTGACCATCACTGGGGCTCAGGCGGAAGAT GAGGCTGACTATTACTGTAACTCCCGTGATAGTAGCGGTAATCA TGTGGTATTCGGCGGAGGGACCAAGCTGACCGTCCTAGGACAAC CCAAGGCTGCCCCCAGCGTGACCCTGTTCCCCCCCAGCAGCGAG GAATTGCAGGCCAACAAGGCCACCCTGGTCTGCCTGATCAGCGA CTTCTACCCAGGCGCCGTGACCGTGGCCTGGAAGGCCGACAGCA GCCCCGTGAAGGCCGGCGTGGAGACCACCACCCCCAGCAAGCA GAGCAACAACAAGTACGCCGCCAGCAGCTACCTGAGCCTGACC CCCGAGCAGTGGAAGAGCCACAGGTCCTACAGCTGCCAGGTGA CCCACGAGGGCAGCACCGTGGAGAAAACCGTGGCCCCCACCGA GTGCAGCGGAGCCGCAGAACAAAAACTCATCTCAGAAGAGGAT CTGAATGGAGCCGCAGACTACAAGGACGACGACGACAAGGGTG CCGCATAATAAGGCGCGCCAATTCTATTTCAAGGAGACAGTCAT ATGAAATACCTGCTGCCGACCGCTGCTGCTGGTCTGCTGCTCCTC GCTGCCCAGCCGGCGATGGCCGAGGTGCAATTGCTGGAGTCTGG GGGAGGCTTGGTACAGCCTGGGGGGTCCCTGAGACTCTCCTGTG CAGCCTCCGGATTCACCTTTAGCAGTTATGCCATGAGCTGGGTCC GCCAGGCTCCAGGGAAGGGGCTGGAGTGGGTCTCAGCTATTAGT GGTAGTGGTGGTAGCACATACTACGCAGACTCCGTGAAGGGCCG GTTCACCATCTCCAGAGACAATTCCAAGAACACGCTGTATCTGC AGATGAACAGCCTGAGAGCCGAGGACACGGCCGTATATTACTGT GCGAAACCGTTTCCGTATTTTGACTACTGGGGCCAAGGAACCCT GGTCACCGTCTCGAGTGCTAGCACCAAAGGCCCATCGGTCTTCC CCCTGGCACCCTCCTCCAAGAGCACCTCTGGGGGCACAGCGGCC CTGGGCTGCCTGGTCAAGGACTACTTCCCCGAACCGGTGACGGT GTCGTGGAACTCAGGCGCCCTGACCAGCGGCGTGCACACCTTCC CGGCTGTCCTACAGTCCTCAGGACTCTACTCCCTCAGCAGCGTG GTGACCGTGCCCTCCAGCAGCTTGGGCACCCAGACCTACATCTG CAACGTGAATCACAAGCCCAGCAACACCAAAGTGGACAAGAAA GTTGAGCCCAAATCTTGTGACGCGGCCGCAAGCACTAGTGCCCA TCACCATCACCATCACGCCGCGGCA |

TABLE 10 cDNA and amino acid sequences of lambda-DP47 library
(Vl3_19/VH3_23) germline template

| SEQ ID NO: | Description | Sequence |
|---|---|---|
| 159 | nucleotide sequence of Fab light chain Vl3_19 | TCGTCTGAGCTGACTCAGGACCCTGCTGTGTCTGTGGCCT TGGGACAGACAGTCAGGATCACATGCCAAGGAGACAGCC TCAGAAGTTATTATGCAAGCTGGTACCAGCAGAAGCCAG GACAGGCCCCTGTACTTGTCATCTATGGTAAAAACAACCG GCCCTCAGGGATCCCAGACCGATTCTCTGGCTCCAGCTCA GGAAACACAGCTTCCTTGACCATCACTGGGGCTCAGGCG GAAGATGAGGCTGACTATTACTGTAACTCCCGTGATAGTA GCGGTAATCATGTGGTATTCGGCGGAGGGACCAAGCTGA CCGTCCTAGGACAACCCAAGGCTGCCCCCAGCGTGACCCT GTTCCCCCCCAGCAGCGAGGAATTGCAGGCCAACAAGGC CACCCTGGTCTGCCTGATCAGCGACTTCTACCCAGGCGCC GTGACCGTGGCCTGGAAGGCCGACAGCAGCCCCGTGAAG GCCGGCGTGGAGACCACCACCCCCAGCAAGCAGAGCAAC AACAAGTACGCCGCCAGCAGCTACCTGAGCCTGACCCCC GAGCAGTGGAAGAGCCACAGGTCCTACAGCTGCCAGGTG ACCCACGAGGGCAGCACCGTGGAGAAAACCGTGGCCCCC ACCGAGTGCAGCGGAGCCGCAGAACAAAAACTCATCTCA GAAGAGGATCTGAATGGAGCCGCAGACTACAAGGACGAC GACGACAAGGGTGCCGCA |
| 160 | Fab light chain Vl3_19 | SSELTQDPAVSVALGQTVRITCQGDSLRSYYASWYQQKPGQ APVLVIYGKNNRPSGIPDRFSGSSSGNTASLTITGAQAEDEAD YYCNSRDSSGNHVVFGGGTKLTVLGQPKAAPSVTLFPPSSEE LQANKATLVCLISDFYPGAVTVAWKADSSPVKAGVETTTPS KQSNNKYAASSYLSLTPEQWKSHRSYSCQVTHEGSTVEKTV APTECSGAAEQKLISEEDLNGAADYKDDDDKGAA |
| 150 | nucleotide sequence of Fab heavy chain VH3_23 | see Table 7 |
| 151 | Fab heavy chain VH3_23 (DP47) | see Table 7 |

TABLE 11

Primer sequences used for generation of lambda-DP47 library (Vl3_19/VH3_23)

| SEQ ID NO: | Primer name | Primer sequence 5'-3' |
|---|---|---|
| 161 | LMB3 | CAGGAAACAGCTATGACCATGATTAC |
| 162 | Vl_3_19_L3r_V | GGACGGTCAGCTTGGTCCCTCCGCCGAATAC VHV ATT ACC GCT ACT ATC ACG GGAGTTACAGTAATAGTCAGCCTCATCTTCCGC<br>underlined: 60% original base and 40% randomization as M<br>bold and italic: 60% original base and 40% randomization as N |
| 163 | Vl_3_19_L3r_HV | GGACGGTCAGCTTGGTCCCTCCGCCGAATAC CMM ATG ATT ACC GCT ACT ATC ACG GGAGTTACAGTAATAGTCAGCCTCATCTTCCGC<br>underlined: 60% original base and 40% randomization as M<br>bolded and italic: 60% original base and 40% randomization as N |
| 164 | Vl_3_19_L3r_HLV | GGACGGTCAGCTTGGTCCCTCCGCCGAATAC RHM VWG ATG ATT ACC GCT ACT ATC ACG GGAGTTACAGTAATAGTCAGCCTCATCTTC CGC<br>underlined: 60% original base and 40% randomization as M<br>bolded and italic: 60% original base and 40% randomization as N |
| 165 | RJH80 | TTCGGCGGAGGGACCAAGCTGACCGTCC |

Additional primers used for construction of the lambda-DP47 library, i.e. DP47CDR3_ba (mod.), DP47-v4-4, DP47-v4-6, DP47-v4-8 and fdseqlong, are identical to the primers used for the construction of the common light chain library (Vk3_20/VH3_23) and have already been listed in Table 8.

Clones 8H9, 20B7, 49B4, 1G4, CLC-563, CLC-564 and 17A9 were identified as human Ox40-specific binders through the procedure described above. The cDNA sequences of their variable regions are shown in Table 12 below, the corresponding amino acid sequences can be found in Table C.

TABLE 12

Variable region base pair sequences for phage-derived anti-Ox40 antibodies. Underlined are the complementarity determining regions (CDRs).

| Clone | SEQ ID NO: | Sequence |
|---|---|---|
| 8H9 | 166 (VL) | TCGTCTGAGCTGACTCAGGACCCTGCTGTGTCTGTGGCCTTGGGACA GACAGTCAGGATCACATGCCAAGGAGACAGCCTCAGAAGTTATTAT GCAAGCTGGTACCAGCAGAAGCCAGGACAGGCCCCTGTACTTGTCA TCTATGGTAAAAACAACCGGCCCTCAGGGATCCCAGACCGATTCTC TGGCTCCAGCTCAGGAAACACAGCTTCCTTGACCATCACTGGGGCT CAGGCGGAAGATGAGGCTGACTATTACTGTAACTCCCGTGTTATGC CTCATAATCGCGTATTCGGCGGAGGGACCAAGCTGACCGTC |
| | 167 (VH) | GAGGTGCAATTGTTGGAGTCTGGGGGAGGCTTGGTACAGCCTGGGG GGTCCCTGAGACTCTCCTGTGCAGCCTCCGGATTCACCTTTAGCAGT TATGCCATGAGCTGGGTCCGCCAGGCTCCAGGGAAGGGGCTGGAGT GGGTCTCAGCTATTAGTGGTAGTGGTGGTAGCACATACTACGCAGA CTCCGTGAAGGGCCGGTTCACCATCTCCAGAGACAATTCCAAGAAC ACGCTGTATCTGCAGATGAACAGCCTGAGAGCCGAGGACACGGCCG TATATTACTGTGCGCGTGTTTTCTACCGTGGTGGTGTTTCTATGGAC TACTGGGGCCAAGGAACCCTGGTCACCGTCTCGAGT |
| 49B4 | 168 (VL) | GACATCCAGATGACCCAGTCTCCTTCCACCCTGTCTGCATCTGTAGG AGACCGTGTCACCATCACTTGCCGTGCCAGTCAGAGTATTAGTAGC TGGTTGGCCTGGTATCAGCAGAAACCAGGGAAAGCCCCTAAGCTCC TGATCTATGATGCCTCCAGTTTGGAAAGTGGGGTCCCATCACGTTTC AGCGGCAGTGGATCCGGGACAGAATTCACTCTCACCATCAGCAGCT TGCAGCCTGATGATTTTGCAACTTATTACTGCCAACAGTATAGTTCG CAGCCGTATACGTTTGGCCAGGGCACCAAAGTCGAGATCAAG |
| | 169 (VH) | CAGGTGCAATTGGTGCAGTCTGGGGCTGAGGTGAAGAAGCCTGGGT CCTCGGTGAAGGTCTCCTGCAAGGCCTCCGGAGGCACATTCAGCAG CTACGCTATAAGCTGGGTGCGACAGGCCCCTGGACAAGGGCTCGAG TGGATGGGAGGGATCATCCCTATCTTTGGTACAGCAAACTACGCAC AGAAGTTCCAGGGCAGGGTCACCATTACTGCAGACAAATCCACGAG CACAGCCTACATGGAGCTGAGCAGCCTGAGATCTGAGGACACCGCC GTGTATTACTGTGCGAGAGAATACTACCGTGGTCCGTACGACTACT GGGGCCAAGGGACCACCGTGACCGTCTCCTCA |
| 1G4 | 170 (VL) | GACATCCAGATGACCCAGTCTCCTTCCACCCTGTCTGCATCTGTAGG AGACCGTGTCACCATCACTTGCCGTGCCAGTCAGAGTATTAGTAGC TGGTTGGCCTGGTATCAGCAGAAACCAGGGAAAGCCCCTAAGCTCC TGATCTATGATGCCTCCAGTTTGGAAAGTGGGGTCCCATCACGTTTC AGCGGCAGTGGATCCGGGACAGAATTCACTCTCACCATCAGCAGCT TGCAGCCTGATGATTTTGCAACTTATTACTGCCAACAGTATATTTCG TATTCCATGTTGACGTTTGGCCAGGGCACCAAAGTCGAGATCAAG |
| | 171 (VH) | CAGGTGCAATTGGTGCAGTCTGGGGCTGAGGTGAAGAAGCCTGGGT CCTCGGTGAAGGTCTCCTGCAAGGCCTCCGGAGGCACATTCAGCAG CTACGCTATAAGCTGGGTGCGACAGGCCCCTGGACAAGGGCTCGAG TGGATGGGAGGGATCATCCCTATCTTTGGTACAGCAAACTACGCAC AGAAGTTCCAGGGCAGGGTCACCATTACTGCAGACAAATCCACGAG CACAGCCTACATGGAGCTGAGCAGCCTGAGATCTGAGGACACCGCC GTGTATTACTGTGCGAGAGAATACGGTTCTATGGACTACTGGGGCC AAGGGACCACCGTGACCGTCTCCTCA |
| 20B7 | 172 (VL) | GACATCCAGATGACCCAGTCTCCTTCCACCCTGTCTGCATCTGTAGG AGACCGTGTCACCATCACTTGCCGTGCCAGTCAGAGTATTAGTAGC TGGTTGGCCTGGTATCAGCAGAAACCAGGGAAAGCCCCTAAGCTCC TGATCTATGATGCCTCCAGTTTGGAAAGTGGGGTCCCATCACGTTTC AGCGGCAGTGGATCCGGGACAGAATTCACTCTCACCATCAGCAGCT TGCAGCCTGATGATTTTGCAACTTATTACTGCCAACAGTATCAGGCT TTTTCGCTTACGTTTGGCCAGGGCACCAAAGTCGAGATCAAG |
| | 173 (VH) | CAGGTGCAATTGGTGCAGTCTGGGGCTGAGGTGAAGAAGCCTGGGT CCTCGGTGAAGGTCTCCTGCAAGGCCTCCGGAGGCACATTCAGCAG CTACGCTATAAGCTGGGTGCGACAGGCCCCTGGACAAGGGCTCGAG TGGATGGGAGGGATCATCCCTATCTTTGGTACAGCAAACTACGCAC AGAAGTTCCAGGGCAGGGTCACCATTACTGCAGACAAATCCACGAG CACAGCCTACATGGAGCTGAGCAGCCTGAGATCTGAGGACACCGCC GTGTATTACTGTGCGAGAGTTAACTACCCGTACTCTTACTGGGGTGA CTTCGACTACTGGGGCCAAGGGACCACCGTGACCGTCTCCTCA |

TABLE 12-continued

Variable region base pair sequences for phage-derived anti-Ox40 antibodies. Underlined are the complementarity determining regions (CDRs).

| Clone | SEQ ID NO: | Sequence |
|---|---|---|
| CLC-563 | 174 (VL) | GAGATCGTGCTGACCCAGAGCCCCGGCACACTCTCCCTGTCTCCTG GGGAAAGGGCCACCCTTTCATGC<u>AGAGCCAGCCAGTCCGTCTCTAG TAGCTACCTGGCAT</u>GGTATCAGCAGAAGCCAGGACAAGCCCCCCGC CTCCTGATTTAC<u>GGCGCTTCCTCTCGGGCAACT</u>GGTATCCCTGACAG GTTCTCAGGGAGCGGAAGCGGAACAGATTTTACCTTGACTATTTCT AGACTGGAGCCAGAGGACTTCGCCGTGTATTACTGT<u>CAGCAGTACG GTAGTAGCCCCCTCACC</u>TTTGGCCAGGGGACAAAAGTCGAAATCAAG |
|  | 175 (VH) | GAGGTGCAATTGTTGGAGTCTGGGGGAGGCTTGGTACAGCCTGGGG GGTCCCTGAGACTCTCCTGTGCAGCCTCCGGATTCACCTTTAGC<u>AGT TATGCCATGAGC</u>TGGGTCCGCCAGGCTCCAGGGAAGGGGCTGGAGT GGGTCTCAG<u>CTATTAGTGGTAGTGGTGGTAGCACATACTACGCAGA CTCCGTGAAGGGC</u>CGGTTCACCATCTCCAGAGACAATTCCAAGAAC ACGCTGTATCTGCAGATGAACAGCCTGAGAGCCGAGGACACGGCCG TATATTACTGTGCGCTT<u>GACGTTGGTGCTTTCGACTAC</u>TGGGGCCAA GGAGCCCTGGTCACCGTCTCGAGT |
| CLC-564 | 176 (VL) | GAGATCGTGCTGACCCAGAGCCCCGGCACACTCTCCCTGTCTCCTG GGGAAAGGGCCACCCTTTCATGC<u>AGAGCCAGCCAGTCCGTCTCTAG TAGCTACCTGGCAT</u>GGTATCAGCAGAAGCCAGGACAAGCCCCCCGC CTCCTGATTTAC<u>GGCGCTTCCTCTCGGGCAACT</u>GGTATCCCTGACAG GTTCTCAGGGAGCGGAAGCGGAACAGATTTTACCTTGACTATTTCT AGACTGGAGCCAGAGGACTTCGCCGTGTATTACTGT<u>CAGCAGTACG GTAGTAGCCCCCTCACC</u>TTTGGCCAGGGGACAAAAGTCGAAATCAAG |
|  | 177 (VH) | GAGGTGCAATTGTTGGAGTCTGGGGGAGGCTTGGTACAGCCTGGGG GGTCCCTGAGACTCTCCTGTGCAGCCTCCGGATTCACCTTTAGC<u>AGT TATGCCATGAGC</u>TGGGTCCGCCAGGCTCCAGGGAAGGGGCTGGAGT GGGTCTCAG<u>CTATTAGTGGTAGTGGTGGTAGCACATACTACGCAGA CTCCGTGAAGGGC</u>CGGTTCACCATCTCCAGAGACAATTCCAAGAAC ACGCTGTATCTGCAGATGAACAGCCTGAGAGCCGAGGACACGGCCG TATATTACTGTGCGTTC<u>GACGTTGGTCCGTTCGACTAC</u>TGGGGCCAA GGAACCCTGGTCACCGTCTCGAGT |
| 17A9 | 178 (VL) | TCGTCTGAGCTGACTCAGGACCCTGCTGTGTCTGTGGCCTTGGGACA GACAGTCAGGATCACATGC<u>CAAGGAGACAGCCTCAGAAGTTATTAT GCAAGC</u>TGGTACCAGCAGAAGCCAGGACAGGCCCCTGTACTTGTCA TCTAT<u>GGTAAAAACAACCGGCCCTC</u>AGGGATCCCAGACCGATTCTC TGGCTCCAGCTCAGGAAACACAGCTTCCTTGACCATCACTGGGGCT CAGGCGGAAGATGAGGCTGACTATTACTGT<u>AACTCCCGTGTTATGC CTCATAATCGCGTATT</u>CGGCGGAGGGACCAAGCTGACCGTC |
|  | 179 (VH) | GAGGTGCAATTGTTGGAGTCTGGGGGAGGCTTGGTACAGCCTGGGG GGTCCCTGAGACTCTCCTGTGCAGCCTCCGGATTCACCTTTAGC<u>AGT TATGCCATGAGC</u>TGGGTCCGCCAGGCTCCAGGGAAGGGGCTGGAGT GGGTCTCAG<u>CTATTAGTGGTAGTGGTGGTAGCACATACTACGCAGA CTCCGTGAAGGGC</u>CGGTTCACCATCTCCAGAGACAATTCCAAGAAC ACGCTGTATCTGCAGATGAACAGCCTGAGAGCCGAGGACACGGCCG TATATTACTGTGCGCGT<u>GTTTTCTACCGTGGTGGTGTTTCTATGGAC TAC</u>TGGGGCCAAGGAACCCTGGTCACCGTCTCGAGT |

1.3 Preparation, Purification and Characterization of Anti-Ox40 IgG1 P329G LALA Antibodies The variable regions of heavy and light chain DNA sequences of selected anti-Ox40 binders were subcloned in frame with either the constant heavy chain or the constant light chain of human IgG1. The Pro329Gly, Leu234Ala and Leu235Ala mutations have been introduced in the constant region of the knob and hole heavy chains to abrogate binding to Fc gamma receptors according to the method described in International Patent Appl. Publ. No. WO 2012/130831 A1.

The cDNA and amino acid sequences of the anti-Ox40 clones are shown in Table 13. All anti-Ox40-Fc-fusion encoding sequences were cloned into a plasmid vector, which drives expression of the insert from an MPSV promoter and contains a synthetic polyA signal sequence located at the 3' end of the CDS. In addition, the vector contains an EBV OriP sequence for episomal maintenance of the plasmid.

TABLE 13

Sequences of anti-Ox40 clones in P329GLALA human IgG1 format

| Clone | SEQ ID No. | Sequence |
|---|---|---|
| 8B9 | 180 (nucleotide sequence light | GACATCCAGATGACCCAGTCTCCTTCCACCCTGTCTGCATCTGT AGGAGACCGTGTCACCATCACTTGCCGTGCCAGTCAGAGTATT AGTAGCTGGTTGGCCTGGTATCAGCAGAAACCAGGGAAAGCC |

TABLE 13-continued

Sequences of anti-Ox40 clones in P329GLALA human IgG1 format

| Clone | SEQ ID No. | Sequence |
|---|---|---|
| | chain) | CCTAAGCTCCTGATCTATGATGCCTCCAGTTTGGAAAGTGGGG<br>TCCCATCACGTTTCAGCGGCAGTGGATCCGGGACAGAATTCAC<br>TCTCACCATCAGCAGCTTGCAGCCTGATGATTTTGCAACTTATT<br>ACTGCCAACAGTATTTGACGTATTCGCGGTTTACGTTTGGCCAG<br>GGCACCAAAGTCGAGATCAAGCGTACGGTGGCTGCACCATCTG<br>TCTTCATCTTCCCGCCATCTGATGAGCAGTTGAAATCTGGAACT<br>GCCTCTGTTGTGTGCCTGCTGAATAACTTCTATCCCAGAGAGGC<br>CAAAGTACAGTGGAAGGTGGATAACGCCCTCCAATCGGGTAA<br>CTCCCAGGAGAGTGTCACAGAGCAGGACAGCAAGGACAGCAC<br>CTACAGCCTCAGCAGCACCCTGACGCTGAGCAAAGCAGACTAC<br>GAGAAACACAAAGTCTACGCCTGCGAAGTCACCCATCAGGGC<br>CTGAGCTCGCCCGTCACAAAGAGCTTCAACAGGGGAGAGTGT |
| | 181<br>(nucleotide<br>sequence heavy<br>chain) | CAGGTGCAATTGGTGCAGTCTGGGGCTGAGGTGAAGAAGCCTG<br>GGTCCTCGGTGAAGGTCTCCTGCAAGGCCTCCGGAGGCACATT<br>CAGCAGCTACGCTATAAGCTGGGTGCGACAGGCCCCTGGACAA<br>GGGCTCGAGTGGATGGGAGGGATCATCCCTATCTTTGGTACAG<br>CAAACTACGCACAGAAGTTCCAGGGCAGGGTCACCATTACTGC<br>AGACAAATCCACGAGCACAGCCTACATGGAGCTGAGCAGCCT<br>GAGATCTGAGGACACCGCCGTGTATTACTGTGCGAGAGAATAC<br>GGTTGGATGGACTACTGGGGCCAAGGGACCACCGTGACCGTCT<br>CCTCAGCTAGCACCAAGGGCCCATCGGTCTTCCCCCTGGCACC<br>CTCCTCCAAGAGCACCTCTGGGGGCACAGCGGCCCTGGGCTGC<br>CTGGTCAAGGACTACTTCCCCGAACCGGTGACGGTGTCGTGGA<br>ACTCAGGCGCCCTGACCAGCGGCGTGCACACCTTCCCGGCTGT<br>CCTACAGTCCTCAGGACTCTACTCCCTCAGCAGCGTGGTGACC<br>GTGCCCTCCAGCAGCTTGGGCACCCAGACCTACATCTGCAACG<br>TGAATCACAAGCCCAGCAACACCAAGGTGGACAAGAAAGTTG<br>AGCCCAAATCTTGTGACAAAACTCACACATGCCCACCGTGCCC<br>AGCACCTGAAGCTGCAGGGGGACCGTCAGTCTTCCTCTTCCCC<br>CCAAAACCCAAGGACACCCTCATGATCTCCCGGACCCCTGAGG<br>TCACATGCGTGGTGGTGGACGTGAGCCACGAAGACCCTGAGGT<br>CAAGTTCAACTGGTACGTGGACGGCGTGGAGGTGCATAATGCC<br>AAGACAAAGCCGCGGGAGGAGCAGTACAACAGCACGTACCGT<br>GTGGTCAGCGTCCTCACCGTCCTGCACCAGGACTGGCTGAATG<br>GCAAGGAGTACAAGTGCAAGGTCTCCAACAAAGCCCTCGGCG<br>CCCCCATCGAGAAAACCATCTCCAAAGCCAAAGGGCAGCCCC<br>GAGAACCACAGGTGTACACCCTGCCCCCATCCCGGGATGAGCT<br>GACCAAGAACCAGGTCAGCCTGACCTGCCTGGTCAAAGGCTTC<br>TATCCCAGCGACATCGCCGTGGAGTGGGAGAGCAATGGGCAG<br>CCGGAGAACAACTACAAGACCACGCCTCCCGTGCTGGACTCCG<br>ACGGCTCCTTCTTCCTCTACAGCAAGCTCACCGTGGACAAGAG<br>CAGGTGGCAGCAGGGGAACGTCTTCTCATGCTCCGTGATGCAT<br>GAGGCTCTGCACAACCACTACACGCAGAAGAGCCTCTCCCTGT<br>CTCCGGGTAAA |
| | 182<br>(Light chain) | DIQMTQSPSTLSASVGDRVTITCRASQSISSWLAWYQQKPGKAPK<br>LLIYDASSLESGVPSRFSGSGSGTEFTLTISSLQPDDFATYYCQQYL<br>TYSRFTFGQGTKVEIKRTVAAPSVFIFPPSDEQLKSGTASVVCLLN<br>NFYPREAKVQWKVDNALQSGNSQESVTEQDSKDSTYSLSSTLTLS<br>KADYEKHKVYACEVTHQGLSSPVTKSFNRGEC |
| | 183<br>(Heavy chain) | QVQLVQSGAEVKKPGSSVKVSCKASGGTFSSYAISWVRQAPGQG<br>LEWMGGIIPIFGTANYAQKFQGRVTITADKSTSTAYMELSSLRSED<br>TAVYYCAREYGWMDYWGQGTTVTVSSASTKGPSVFPLAPSSKST<br>SGGTAALGCLVKDYFPEPVTVSWNSGALTSGVHTFPAVLQSSGL<br>YSLSSVVTVPSSSLGTQTYICNVNHKPSNTKVDKKVEPKSCDKTH<br>TCPPCPAPEAAGGPSVFLFPPKPKDTLMISRTPEVTCVVVDVSHED<br>PEVKFNWYVDGVEVHNAKTKPREEQYNSTYRVVSVLTVLHQDW<br>LNGKEYKCKVSNKALGAPIEKTISKAKGQPREPQVYTLPPSRDEL<br>TKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 49B4 | 184<br>(nucleotide<br>sequence light<br>chain) | GACATCCAGATGACCCAGTCTCCTTCCACCCTGTCTGCATCTGT<br>AGGAGACCGTGTCACCATCACTTGCCGTGCCAGTCAGAGTATT<br>AGTAGCTGGTTGGCCTGGTATCAGCAGAAACCAGGGAAAGCC<br>CCTAAGCTCCTGATCTATGATGCCTCCAGTTTGGAAAGTGGGG<br>TCCCATCACGTTTCAGCGGCAGTGGATCCGGGACAGAATTCAC<br>TCTCACCATCAGCAGCTTGCAGCCTGATGATTTTGCAACTTATT<br>ACTGCCAACAGTATAGTTCGCAGCCGTATACGTTTGGCCAGGG<br>CACCAAAGTCGAGATCAAGCGTACGGTGGCTGCACCATCTGTC<br>TTCATCTTCCCGCCATCTGATGAGCAGTTGAAATCTGGAACTGC<br>CTCTGTTGTGTGCCTGCTGAATAACTTCTATCCCAGAGAGGCCA<br>AAGTACAGTGGAAGGTGGATAACGCCCTCCAATCGGGTAACTC<br>CCAGGAGAGTGTCACAGAGCAGGACAGCAAGGACAGCACCTA<br>CAGCCTCAGCAGCACCCTGACGCTGAGCAAAGCAGACTACGA<br>GAAACACAAAGTCTACGCCTGCGAAGTCACCCATCAGGGCCTG<br>AGCTCGCCCGTCACAAAGAGCTTCAACAGGGGAGAGTGT |

TABLE 13-continued

Sequences of anti-Ox40 clones in P329GLALA human IgG1 format

| Clone | SEQ ID No. | Sequence |
|---|---|---|
| | 185 (nucleotide sequence heavy chain) | CAGGTGCAATTGGTGCAGTCTGGGGCTGAGGTGAAGAAGCCTG GGTCCTCGGTGAAGGTCTCCTGCAAGGCCTCCGGAGGCACATT CAGCAGCTACGCTATAAGCTGGGTGCGACAGGCCCCTGGACAA GGGCTCGAGTGGATGGGAGGGATCATCCCTATCTTTGGTACAG CAAACTACGCACAGAAGTTCCAGGGCAGGGTCACCATTACTGC AGACAAATCCACGAGCACAGCCTACATGGAGCTGAGCAGCCT GAGATCTGAGGACACCGCCGTGTATTACTGTGCGAGAGAATAC TACCGTGGTCCGTACGACTACTGGGGCCAAGGGACCACCGTGA CCGTCTCCTCAGCTAGCACCAAGGGCCCATCGGTCTTCCCCCTG GCACCCTCCTCCAAGAGCACCTCTGGGGGCACAGCGGCCCTGG GCTGCCTGGTCAAGGACTACTTCCCCGAACCGGTGACGGTGTC GTGGAACTCAGGCGCCCTGACCAGCGGCGTGCACACCTTCCCG GCTGTCCTACAGTCCTCAGGACTCTACTCCCTCAGCAGCGTGGT GACCGTGCCCTCCAGCAGCTTGGGCACCCAGACCTACATCTGC AACGTGAATCACAAGCCCAGCAACACCAAGGTGGACAAGAAA GTTGAGCCCAAATCTTGTGACAAAACTCACACATGCCCACCGT GCCCAGCACCTGAAGCTGCAGGGGGACCGTCAGTCTTCCTCTT CCCCCCAAAACCCAAGGACACCCTCATGATCTCCCGGACCCCT GAGGTCACATGCGTGGTGGTGGACGTGAGCCACGAAGACCCT GAGGTCAAGTTCAACTGGTACGTGGACGGCGTGGAGGTGCATA ATGCCAAGACAAAGCCGCGGGAGGAGCAGTACAACAGCACGT ACCGTGTGGTCAGCGTCCTCACCGTCCTGCACCAGGACTGGCT GAATGGCAAGGAGTACAAGTGCAAGGTCTCCAACAAAGCCCT CGGCGCCCCCATCGAGAAAACCATCTCCAAAGCCAAAGGGCA GCCCCGAGAACCACAGGTGTACACCCTGCCCCCATCCCGGGAT GAGCTGACCAAGAACCAGGTCAGCCTGACCTGCCTGGTCAAAG GCTTCTATCCCAGCGACATCGCCGTGGAGTGGGAGAGCAATGG GCAGCCGGAGAACAACTACAAGACCACGCCTCCCGTGCTGGA CTCCGACGGCTCCTTCTTCCTCTACAGCAAGCTCACCGTGGACA AGAGCAGGTGGCAGCAGGGGAACGTCTTCTCATGCTCCGTGAT GCATGAGGCTCTGCACAACCACTACACGCAGAAGAGCCTCTCC CTGTCTCCGGGTAAA |
| | 186 (Light chain) | DIQMTQSPSTLSASVGDRVTITCRASQSISSWLAWYQQKPGKAPK LLIYDASSLESGVPSRFSGSGSGTEFTLTISSLQPDDFATYYCQQYS SQPYTFGQGTKVEIKRTVAAPSVFIFPPSDEQLKSGTASVVCLLNN FYPREAKVQWKVDNALQSGNSQESVTEQDSKDSTYSLSSTLTLSK ADYEKHKVYACEVTHQGLSSPVTKSFNRGEC |
| | 187 (Heavy chain) | QVQLVQSGAEVKKPGSSVKVSCKASGGTFSSYAISWVRQAPGQG LEWMGGIIPIFGTANYAQKFQGRVTITADKSTSTAYMELSSLRSED TAVYYCAREYYRGPYDYWGQGTTVTVSSASTKGPSVFPLAPSSK STSGGTAALGCLVKDYFPEPVTVSWNSGALTSGVHTFPAVLQSSG LYSLSSVVTVPSSSLGTQTYICNVNHKPSNTKVDKKVEPKSCDKT HTCPPCPAPEAAGGPSVFLFPPKPKDTLMISRTPEVTCVVVDVSHE DPEVKFNWYVDGVEVHNAKTKPREEQYNSTYRVVSVLTVLHQD WLNGKEYKCKVSNKALGAPIEKTISKAKGQPREPQVYTLPPSRDE LTKNQVSLTCLVKGFYPSDIAVEWESNGQPENNYKTTPPVLDSDG SFFLYSKLTVDKSRWQQGNVFSCSVMHEALHNHYTQKSLSLSPGK |
| 1G4 | 188 (nucleotide sequence light chain) | GACATCCAGATGACCCAGTCTCCTTCCACCCTGTCTGCATCTGT AGGAGACCGTGTCACCATCACTTGCCGTGCCAGTCAGAGTATT AGTAGCTGGTTGGCCTGGTATCAGCAGAAACCAGGGAAAGCC CCTAAGCTCCTGATCTATGATGCCTCCAGTTTGGAAAGTGGGG TCCCATCACGTTTCAGCGGCAGTGGATCCGGGACAGAATTCAC TCTCACCATCAGCAGCTTGCAGCCTGATGATTTTGCAACTTATT ACTGCCAACAGTATATTTCGTATTCCATGTTGACGTTTGGCCAG GGCACCAAAGTCGAGATCAAGCGTACGGTGGCTGCACCATCTG TCTTCATCTTCCCGCCATCTGATGAGCAGTTGAAATCTGGAACT GCCTCTGTTGTGTGCCTGCTGAATAACTTCTATCCCAGAGAGGC CAAAGTACAGTGGAAGGTGGATAACGCCCTCCAATCGGGTAA CTCCCAGGAGAGTGTCACAGAGCAGGACAGCAAGGACAGCAC CTACAGCCTCAGCAGCACCCTGACGCTGAGCAAAGCAGACTAC GAGAAACACAAAGTCTACGCCTGCGAAGTCACCCATCAGGGC CTGAGCTCGCCCGTCACAAAGAGCTTCAACAGGGGAGAGTGT |
| | 189 (nucleotide sequence heavy chain) | CAGGTGCAATTGGTGCAGTCTGGGGCTGAGGTGAAGAAGCCTG GGTCCTCGGTGAAGGTCTCCTGCAAGGCCTCCGGAGGCACATT CAGCAGCTACGCTATAAGCTGGGTGCGACAGGCCCCTGGACAA GGGCTCGAGTGGATGGGAGGGATCATCCCTATCTTTGGTACAG CAAACTACGCACAGAAGTTCCAGGGCAGGGTCACCATTACTGC AGACAAATCCACGAGCACAGCCTACATGGAGCTGAGCAGCCT GAGATCTGAGGACACCGCCGTGTATTACTGTGCGAGAGAATAC GGTTCTATGGACTACTGGGGCCAAGGGACCACCGTGACCGTCT CCTCAGCTAGCACCAAGGGCCCATCGGTCTTCCCCCTGGCACC CTCCTCCAAGAGCACCTCTGGGGGCACAGCGGCCCTGGGCTGC CTGGTCAAGGACTACTTCCCCGAACCGGTGACGGTGTCGTGGA ACTCAGGCGCCCTGACCAGCGGCGTGCACACCTTCCCGGCTGT CCTACAGTCCTCAGGACTCTACTCCCTCAGCAGCGTGGTGACC |

TABLE 13-continued

Sequences of anti-Ox40 clones in P329GLALA human IgG1 format

| Clone | SEQ ID No. | Sequence |
|---|---|---|
| | | GTGCCCTCCAGCAGCTTGGGCACCCAGACCTACATCTGCAACG<br>TGAATCACAAGCCCAGCAACACCAAGGTGGACAAGAAAGTTG<br>AGCCCAAATCTTGTGACAAAACTCACACATGCCCACCGTGCCC<br>AGCACCTGAAGCTGCAGGGGGACCGTCAGTCTTCCTCTTCCCC<br>CCAAAACCCAAGGACACCCTCATGATCTCCCGGACCCCTGAGG<br>TCACATGCGTGGTGGTGGACGTGAGCCACGAAGACCCTGAGGT<br>CAAGTTCAACTGGTACGTGGACGGCGTGGAGGTGCATAATGCC<br>AAGACAAAGCCGCGGGAGGAGCAGTACAACAGCACGTACCGT<br>GTGGTCAGCGTCCTCACCGTCCTGCACCAGGACTGGCTGAATG<br>GCAAGGAGTACAAGTGCAAGGTCTCCAACAAAGCCCTCGGCG<br>CCCCCATCGAGAAAACCATCTCCAAAGCCAAAGGGCAGCCCC<br>GAGAACCACAGGTGTACACCCTGCCCCCATCCCGGGATGAGCT<br>GACCAAGAACCAGGTCAGCCTGACCTGCCTGGTCAAAGGCTTC<br>TATCCCAGCGACATCGCCGTGGAGTGGGAGAGCAATGGGCAG<br>CCGGAGAACAACTACAAGACCACGCCTCCCGTGCTGGACTCCG<br>ACGGCTCCTTCTTCCTCTACAGCAAGCTCACCGTGGACAAGAG<br>CAGGTGGCAGCAGGGGAACGTCTTCTCATGCTCCGTGATGCAT<br>GAGGCTCTGCACAACCACTACACGCAGAAGAGCCTCTCCCTGT<br>CTCCGGGTAAA |
| | 190<br>(Light chain) | DIQMTQSPSTLSASVGDRVTITCRASQSISSWLAWYQQKPGKAPK<br>LLIYDASSLESGVPSRFSGSGSGTEFTLTISSLQPDDFATYYCQQYIS<br>YSMLTFGQGTKVEIKRTVAAPSVFIFPPSDEQLKSGTASVVCLLNN<br>FYPREAKVQWKVDNALQSGNSQESVTEQDSKDSTYSLSSTLTLSK<br>ADYEKHKVYACEVTHQGLSSPVTKSFNRGEC |
| | 191<br>(Heavy chain) | QVQLVQSGAEVKKPGSSVKVSCKASGGTFSSYAISWVRQAPGQG<br>LEWMGGIIPIFGTANYAQKFQGRVTITADKSTSTAYMELSSLRSED<br>TAVYYCAREYGSMDYWGQGTTVTVSSASTKGPSVFPLAPSSKST<br>SGGTAALGCLVKDYFPEPVTVSWNSGALTSGVHTFPAVLQSSGL<br>YSLSSVVTVPSSSLGTQTYICNVNHKPSNTKVDKKVEPKSCDKTH<br>TCPPCPAPEAAGGPSVFLFPPKPKDTLMISRTPEVTCVVVDVSHED<br>PEVKFNWYVDGVEVHNAKTKPREEQYNSTYRVVSVLTVLHQDW<br>LNGKEYKCKVSNKALGAPIEKTISKAKGQPREPQVYTLPPSRDEL<br>TKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| 20B7 | 192<br>(nucleotide<br>sequence light<br>chain) | GACATCCAGATGACCCAGTCTCCTTCCACCCTGTCTGCATCTGT<br>AGGAGACCGTGTCACCATCACTTGCCGTGCCAGTCAGAGTATT<br>AGTAGCTGGTTGGCCTGGTATCAGCAGAAACCAGGGAAAGCC<br>CCTAAGCTCCTGATCTATGATGCCTCCAGTTTGGAAAGTGGGG<br>TCCCATCACGTTTCAGCGGCAGTGGATCCGGGACAGAATTCAC<br>TCTCACCATCAGCAGCTTGCAGCCTGATGATTTTGCAACTTATT<br>ACTGCCAACAGTATCAGGCTTTTTCGCTTACGTTTGGCCAGGGC<br>ACCAAGTCGAGATCAAGCGTACGGTGGCTGCACCATCTGTCT<br>TCATCTTCCCGCCATCTGATGAGCAGTTGAAATCTGGAACTGC<br>CTCTGTTGTGTGCCTGCTGAATAACTTCTATCCCAGAGAGGCCA<br>AAGTACAGTGGAAGGTGGATAACGCCCTCCAATCGGGTAACTC<br>CCAGGAGAGTGTCACAGAGCAGGACAGCAAGGACAGCACCTA<br>CAGCCTCAGCAGCACCCTGACGCTGAGCAAAGCAGACTACGA<br>GAAACACAAAGTCTACGCCTGCGAAGTCACCCATCAGGGCCTG<br>AGCTCGCCCGTCACAAAGAGCTTCAACAGGGGAGAGTGT |
| | 193<br>(nucleotide<br>sequence heavy<br>chain) | CAGGTGCAATTGGTGCAGTCTGGGGCTGAGGTGAAGAAGCCTG<br>GGTCCTCGGTGAAGGTCTCCTGCAAGGCCTCCGGAGGCACATT<br>CAGCAGCTACGCTATAAGCTGGGTGCGACAGGCCCCTGGACAA<br>GGGCTCGAGTGGATGGGAGGGATCATCCCTATCTTTGGTACAG<br>CAAACTACGCACAGAAGTTCCAGGGCAGGGTCACCATTACTGC<br>AGACAAATCCACGAGCACAGCCTACATGGAGCTGAGCAGCCT<br>GAGATCTGAGGACACCGCCGTGTATTACTGTGCGAGAGTTAAC<br>TACCCGTACTCTTACTGGGGTGACTTCGACTACTGGGGCCAAG<br>GGACCACCGTGACCGTCTCCTCAGCTAGCACCAAGGGCCCATC<br>GGTCTTCCCCCTGGCACCCTCCTCCAAGAGCACCTCTGGGGGC<br>ACAGCGGCCCTGGGCTGCCTGGTCAAGGACTACTTCCCCGAAC<br>CGGTGACGGTGTCGTGGAACTCAGGCGCCCTGACCAGCGGCGT<br>GCACACCTTCCCGGCTGTCCTACAGTCCTCAGGACTCTACTCCC<br>TCAGCAGCGTGGTGACCGTGCCCTCCAGCAGCTTGGGCACCCA<br>GACCTACATCTGCAACGTGAATCACAAGCCCAGCAACACCAAG<br>GTGGACAAGAAAGTTGAGCCCAAATCTTGTGACAAAACTCACA<br>CATGCCCACCGTGCCCAGCACCTGAAGCTGCAGGGGGACCGTC<br>AGTCTTCCTCTTCCCCCCAAAACCCAAGGACACCCTCATGATCT<br>CCCGGACCCCTGAGGTCACATGCGTGGTGGTGGACGTGAGCCA<br>CGAAGACCCTGAGGTCAAGTTCAACTGGTACGTGGACGGCGTG<br>GAGGTGCATAATGCCAAGACAAAGCCGCGGGAGGAGCAGTAC<br>AACAGCACGTACCGTGTGGTCAGCGTCCTCACCGTCCTGCACC<br>AGGACTGGCTGAATGGCAAGGAGTACAAGTGCAAGGTCTCCA<br>ACAAAGCCCTCGGCGCCCCCATCGAGAAAACCATCTCCAAAGC<br>CAAAGGGCAGCCCCGAGAACCACAGGTGTACACCCTGCCCCC<br>ATCCCGGGATGAGCTGACCAAGAACCAGGTCAGCCTGACCTGC |

TABLE 13-continued

Sequences of anti-Ox40 clones in P329GLALA human IgG1 format

| Clone | SEQ ID No. | Sequence |
|---|---|---|
| | | CTGGTCAAAGGCTTCTATCCCAGCGACATCGCCGTGGAGTGGG<br>AGAGCAATGGGCAGCCGGAGAACAACTACAAGACCACGCCTC<br>CCGTGCTGGACTCCGACGGCTCCTTCTTCCTCTACAGCAAGCTC<br>ACCGTGGACAAGAGCAGGTGGCAGCAGGGGAACGTCTTCTCA<br>TGCTCCGTGATGCATGAGGCTCTGCACAACCACTACACGCAGA<br>AGAGCCTCTCCCTGTCTCCGGGTAAA |
| | 194<br>(Light chain) | DIQMTQSPSTLSASVGDRVTITCRASQSISSWLAWYQQKPGKAPK<br>LLIYDASSLESGVPSRFSGSGSGTEFTLTISSLQPDDFATYYCQQYQ<br>AFSLTFGQGTKVEIKRTVAAPSVFIFPPSDEQLKSGTASVVCLLNN<br>FYPREAKVQWKVDNALQSGNSQESVTEQDSKDSTYSLSSTLTLSK<br>ADYEKHKVYACEVTHQGLSSPVTKSFNRGEC |
| | 195<br>(Heavy chain) | QVQLVQSGAEVKKPGSSVKVSCKASGGTFSSYAISWVRQAPGQG<br>LEWMGGIIPIFGTANYAQKFQGRVTITADKSTSTAYMELSSLRSED<br>TAVYYCARVNYPYSYWGDFDYWGQGTTVTVSSASTKGPSVFPL<br>APSSKSTSGGTAALGCLVKDYFPEPVTVSWNSGALTSGVHTFPAV<br>LQSSGLYSLSSVVTVPSSSLGTQTYICNVNHKPSNTKVDKKVEPKS<br>CDKTHTCPPCPAPEAAGGPSVFLFPPKPKDTLMISRTPEVTCVVVD<br>VSHEDPEVKFNWYVDGVEVHNAKTKPREEQYNSTYRVVSVLTV<br>LHQDWLNGKEYKCKVSNKALGAPIEKTISKAKGQPREPQVYTLPP<br>SRDELTKNQVSLTCLVKGFYPSDIAVEWESNGQPENNYKTTPPVL<br>DSDGSFFLYSKLTVDKSRWQQGNVFSCSVMHEALHNHYTQKSLS<br>LSPGK |
| CLC-<br>563 | 196<br>(nucleotide<br>sequence light<br>chain) | GAGATCGTGCTGACCCAGAGCCCCGGCACACTCTCCCTGTCTC<br>CTGGGGAAAGGGCCACCCTTTCATGCAGAGCCAGCCAGTCCGT<br>CTCTAGTAGCTACCTGGCATGGTATCAGCAGAAGCCAGGACAA<br>GCCCCCCCGCCTCCTGATTTACGGCGCTTCCTCTCGGGCAACTGG<br>TATCCCTGACAGGTTCTCAGGGAGCGGAAGCGGAACAGATTTT<br>ACCTTGACTATTTCTAGACTGGAGCCAGAGGACTTCGCCGTGT<br>ATTACTGTCAGCAGTACGGTAGTAGCCCCCTCACCTTTGGCCA<br>GGGGACAAAAGTCGAAATCAAGCGTACGGTGGCTGCACCATC<br>TGTCTTCATCTTCCCGCCATCTGATGAGCAGTTGAAATCTGGAA<br>CTGCCTCTGTTGTGTGCCTGCTGAATAACTTCTATCCCAGAGAG<br>GCCAAAGTACAGTGGAAGGTGGATAACGCCCTCCAATCGGGT<br>AACTCCCAGGAGAGTGTCACAGAGCAGGACAGCAAGGACAGC<br>ACCTACAGCCTCAGCAGCACCCTGACGCTGAGCAAAGCAGACT<br>ACGAGAAACACAAAGTCTACGCCTGCGAAGTCACCCATCAGG<br>GCCTGAGCTCGCCCGTCACAAAGAGCTTCAACAGGGGAGAGT<br>GT |
| | 197<br>(nucleotide<br>sequence heavy<br>chain) | GAGGTGCAATTGTTGGAGTCTGGGGGAGGCTTGGTACAGCCTG<br>GGGGGTCCCTGAGACTCTCCTGTGCAGCCTCCGGATTCACCTTT<br>AGCAGTTATGCCATGAGCTGGGTCCGCCAGGCTCCAGGGAAGG<br>GGCTGGAGTGGGTCTCAGCTATTAGTGGTAGTGGTGGTAGCAC<br>ATACTACGCAGACTCCGTGAAGGGCCGGTTCACCATCTCCAGA<br>GACAATTCCAAGAACACGCTGTATCTGCAGATGAACAGCCTGA<br>GAGCCGAGGACACGGCCGTATATTACTGTGCGCTTGACGTTGG<br>TGCTTTCGACTACTGGGGCCAAGGAGCCCTGGTCACCGTCTCG<br>AGTGCTAGCACCAAGGGCCCATCGGTCTTCCCCCTGGCACCCT<br>CCTCCAAGAGCACCTCTGGGGGCACAGCGGCCCTGGGCTGCCT<br>GGTCAAGGACTACTTCCCCGAACCGGTGACGGTGTCGTGGAAC<br>TCAGGCGCCCTGACCAGCGGCGTGCACACCTTCCCGGCTGTCC<br>TACAGTCCTCAGGACTCTACTCCCTCAGCAGCGTGGTGACCGT<br>GCCCTCCAGCAGCTTGGGCACCCAGACCTACATCTGCAACGTG<br>AATCACAAGCCCAGCAACACCAAGGTGGACAAGAAAGTTGAG<br>CCCAAATCTTGTGACAAAACTCACACATGCCCACCGTGCCCAG<br>CACCTGAAGCTCAGGGGGACCGTCAGTCTTCCTCTTCCCCCC<br>AAAACCCAAGGACACCCTCATGATCTCCCGGACCCCTGAGGTC<br>ACATGCGTGGTGGTGGACGTGAGCCACGAAGACCCTGAGGTC<br>AAGTTCAACTGGTACGTGGACGGCGTGGAGGTGCATAATGCCA<br>AGACAAAGCCGCGGGAGGAGCAGTACAACAGCACGTACCGTG<br>TGGTCAGCGTCCTCACCGTCCTGCACCAGGACTGGCTGAATGG<br>CAAGGAGTACAAGTGCAAGGTCTCCAACAAAGCCCTCGGCGC<br>CCCCATCGAGAAAACCATCTCCAAAGCCAAAGGGCAGCCCCG<br>AGAACCACAGGTGTACACCCTGCCCCCATCCCGGGATGAGCTG<br>ACCAAGAACCAGGTCAGCCTGACCTGCCTGGTCAAAGGCTTCT<br>ATCCCAGCGACATCGCCGTGGAGTGGGAGAGCAATGGGCAGC<br>CGGAGAACAACTACAAGACCACGCCTCCCGTGCTGGACTCCGA<br>CGGCTCCTTCTTCCTCTACAGCAAGCTCACCGTGGACAAGAGC<br>AGGTGGCAGCAGGGGAACGTCTTCTCATGCTCCGTGATGCATG<br>AGGCTCTGCACAACCACTACACGCAGAAGAGCCTCTCCCTGTC<br>TCCGGGTAAA |
| | 198<br>(Light chain) | EIVLTQSPGTLSLSPGERATLSCRASQSVSSSYLAWYQQKPGQAPR<br>LLIYGASSRATGIPDRFSGSGSGTDFTLTISRLEPEDFAVYYCQQYG<br>SSPLTFGQGTKVEIKRTVAAPSVFIFPPSDEQLKSGTASVVCLLNNF<br>YPREAKVQWKVDNALQSGNSQESVTEQDSKDSTYSLSSTLTLSK<br>ADYEKHKVYACEVTHQGLSSPVTKSFNRGEC |

TABLE 13-continued

Sequences of anti-Ox40 clones in P329GLALA human IgG1 format

| Clone | SEQ ID No. | Sequence |
|---|---|---|
| | 199<br>(Heavy chain) | EVQLLESGGGLVQPGGSLRLSCAASGFTFSSYAMSWVRQAPGKG<br>LEWVSAISGSGGSTYYADSVKGRFTISRDNSKNTLYLQMNSLRAE<br>DTAVYYCALDVGAFDYWGQGALVTVSSASTKGPSVFPLAPSSKS<br>TSGGTAALGCLVKDYFPEPVTVSWNSGALTSGVHTFPAVLQSSGL<br>YSLSSVVTVPSSSLGTQTYICNVNHKPSNTKVDKKVEPKSCDKTH<br>TCPPCPAPEAAGGPSVFLFPPKPKDTLMISRTPEVTCVVVDVSHED<br>PEVKFNWYVDGVEVHNAKTKPREEQYNSTYRVVSVLTVLHQDW<br>LNGKEYKCKVSNKALGAPIEKTISKAKGQPREPQVYTLPPSRDEL<br>TKNQVSLTCLVKGFYPSDIAVEWESNGQPENNYKTTPPVLDSDGS<br>FFLYSKLTVDKSRWQQGNVFSCSVMHEALHNHYTQKSLSLSPGK |
| CLC-564 | 200<br>(nucleotide sequence light chain) | GAGATCGTGCTGACCCAGAGCCCCGGCACACTCTCCCTGTCTC<br>CTGGGGAAAGGGCCACCCTTTCATGCAGAGCCAGCCAGTCCGT<br>CTCTAGTAGCTACCTGGCATGGTATCAGCAGAAGCCAGGACAA<br>GCCCCCCGCCTCCTGATTTACGGCGCTTCCTCTCGGGCAACTGG<br>TATCCCTGACAGGTTCTCAGGGAGCGGAAGCGGAACAGATTTT<br>ACCTTGACTATTTCTAGACTGGAGCCAGAGGACTTCGCCGTGT<br>ATTACTGTCAGCAGTACGGTAGTAGCCCCCTCACCTTTGGCCA<br>GGGGACAAAAGTCGAAATCAAGCGTACGGTGGCTGCACCATC<br>TGTCTTCATCTTCCCGCCATCTGATGAGCAGTTGAAATCTGGAA<br>CTGCCTCTGTTGTGTGCCTGCTGAATAACTTCTATCCCAGAGAG<br>GCCAAAGTACAGTGGAAGGTGGATAACGCCCTCCAATCGGGT<br>AACTCCCAGGAGAGTGTCACAGAGCAGGACAGCAAGGACAGC<br>ACCTACAGCCTCAGCAGCACCCTGACGCTGAGCAAAGCAGACT<br>ACGAGAAACACAAAGTCTACGCCTGCGAAGTCACCCATCAGG<br>GCCTGAGCTCGCCCGTCACAAAGAGCTTCAACAGGGGAGAGT<br>GT |
| | 201<br>(nucleotide sequence heavy chain) | GAGGTGCAATTGTTGGAGTCTGGGGGAGGCTTGGTACAGCCTG<br>GGGGGTCCCTGAGACTCTCCTGTGCAGCCTCCGGATTCACCTTT<br>AGCAGTTATGCCATGAGCTGGGTCCGCCAGGCTCCAGGGAAGG<br>GGCTGGAGTGGGTCTCAGCTATTAGTGGTAGTGGTGGTAGCAC<br>ATACTACGCAGACTCCGTGAAGGGCCGGTTCACCATCTCCAGA<br>GACAATTCCAAGAACACGCTGTATCTGCAGATGAACAGCCTGA<br>GAGCCGAGGACACGGCCGTATATTACTGTGCGTTCGACGTTGG<br>TCCGTTCGACTACTGGGGCCAAGGAACCCTGGTCACCGTCTCG<br>AGTGCTAGCACCAAGGGCCCATCGGTCTTCCCCCTGGCACCCT<br>CCTCCAAGAGCACCTCTGGGGGCACAGCGGCCCTGGGCTGCCT<br>GGTCAAGGACTACTTCCCCGAACCGGTGACGGTGTCGTGGAAC<br>TCAGGCGCCCTGACCAGCGGCGTGCACACCTTCCCGGCTGTCC<br>TACAGTCCTCAGGACTCTACTCCCTCAGCAGCGTGGTGACCGT<br>GCCCTCCAGCAGCTTGGGCACCCAGACCTACATCTGCAACGTG<br>AATCACAAGCCCAGCAACACCAAGGTGGACAAGAAAGTTGAG<br>CCCAAATCTTGTGACAAAACTCACACATGCCCACCGTGCCCAG<br>CACCTGAAGCTGCAGGGGGACCGTCAGTCTTCCTCTTCCCCCC<br>AAAACCCAAGGACACCCTCATGATCTCCCGGACCCCTGAGGTC<br>ACATGCGTGGTGGTGGACGTGAGCCACGAAGACCCTGAGGTC<br>AAGTTCAACTGGTACGTGGACGGCGTGGAGGTGCATAATGCCA<br>AGACAAAGCCGCGGGAGGAGCAGTACAACAGCACGTACCGTG<br>TGGTCAGCGTCCTCACCGTCCTGCACCAGGACTGGCTGAATGG<br>CAAGGAGTACAAGTGCAAGGTCTCCAACAAAGCCCTCGGCGC<br>CCCCATCGAGAAAACCATCTCCAAAGCCAAAGGGCAGCCCCG<br>AGAACCACAGGTGTACACCCTGCCCCCATCCCGGGATGAGCTG<br>ACCAAGAACCAGGTCAGCCTGACCTGCCTGGTCAAAGGCTTCT<br>ATCCCAGCGACATCGCCGTGGAGTGGGAGAGCAATGGGCAGC<br>CGGAGAACAACTACAAGACCACGCCTCCCGTGCTGGACTCCGA<br>CGGCTCCTTCTTCCTCTACAGCAAGCTCACCGTGGACAAGAGC<br>AGGTGGCAGCAGGGGAACGTCTTCTCATGCTCCGTGATGCATG<br>AGGCTCTGCACAACCACTACACGCAGAAGAGCCTCTCCCTGTC<br>TCCGGGTAAA |
| | 202<br>(Light chain) | EIVLTQSPGTLSLSPGERATLSCRASQSVSSSYLAWYQQKPGQAPR<br>LLIYGASSRATGIPDRFSGSGSGTDFTLTISRLEPEDFAVYYCQQYG<br>SSPLTFGQGTKVEIKRTVAAPSVFIFPPSDEQLKSGTASVVCLLNNF<br>YPREAKVQWKVDNALQSGNSQESVTEQDSKDSTYSLSSTLTLSK<br>ADYEKHKVYACEVTHQGLSSPVTKSFNRGEC |
| | 203<br>(Heavy chain) | EVQLLESGGGLVQPGGSLRLSCAASGFTFSSYAMSWVRQAPGKG<br>LEWVSAISGSGGSTYYADSVKGRFTISRDNSKNTLYLQMNSLRAE<br>DTAVYYCAFDVGPFDYWGQGTLVTVSSASTKGPSVFPLAPSSKST<br>SGGTAALGCLVKDYFPEPVTVSWNSGALTSGVHTFPAVLQSSGL<br>YSLSSVVTVPSSSLGTQTYICNVNHKPSNTKVDKKVEPKSCDKTH<br>TCPPCPAPEAAGGPSVFLFPPKPKDTLMISRTPEVTCVVVDVSHED<br>PEVKFNWYVDGVEVHNAKTKPREEQYNSTYRVVSVLTVLHQDW<br>LNGKEYKCKVSNKALGAPIEKTISKAKGQPREPQVYTLPPSRDEL<br>TKNQVSLTCLVKGFYPSDIAVEWESNGQPENNYKTTPPVLDSDGS<br>FFLYSKLTVDKSRWQQGNVFSCSVMHEALHNHYTQKSLSLSPGK |

TABLE 13-continued

Sequences of anti-Ox40 clones in P329GLALA human IgG1 format

| Clone | SEQ ID No. | Sequence |
|---|---|---|
| 17A9 | 204 (nucleotide sequence light chain) | TCGTCTGAGCTGACTCAGGACCCTGCTGTGTCTGTGGCCTTGGG<br>ACAGACAGTCAGGATCACATGCCAAGGAGACAGCCTCAGAAG<br>TTATTATGCAAGCTGGTACCAGCAGAAGCCAGGACAGGCCCCT<br>GTACTTGTCATCTATGGTAAAAACAACCGGCCCTCAGGGATCC<br>CAGACCGATTCTCTGGCTCCAGCTCAGGAAACACAGCTTCCTT<br>GACCATCACTGGGGCTCAGGCGGAAGATGAGGCTGACTATTAC<br>TGTAACTCCCGTGTTATGCCTCATAATCGCGTATTCGGCGGAG<br>GGACCAAGCTGACCGTCCTAGGTCAACCCAAGGCTGCCCCCAG<br>CGTGACCCTGTTCCCCCCCAGCAGCGAGGAACTGCAGGCCAAC<br>AAGGCCACCCTGGTCTGCCTGATCAGCGACTTCTACCCAGGCG<br>CCGTGACCGTGGCCTGGAAGGCCGACAGCAGCCCCGTGAAGG<br>CCGGCGTGGAGACCACCACCCCCAGCAAGCAGAGCAACAACA<br>AGTACGCCGCCAGCAGCTACCTGAGCCTGACCCCCGAGCAGTG<br>GAAGAGCCACAGGTCCTACAGCTGCCAGGTGACCCACGAGGG<br>CAGCACCGTGGAGAAAACCGTGGCCCCCACCGAGTGCAGC |
| | 205 (nucleotide sequence heavy chain) | GAGGTGCAATTGTTGGAGTCTGGGGGAGGCTTGGTACAGCCTG<br>GGGGGTCCCTGAGACTCTCCTGTGCAGCCTCCGGATTCACCTTT<br>AGCAGTTATGCCATGAGCTGGGTCCGCCAGGCTCCAGGGAAGG<br>GGCTGGAGTGGGTCTCAGCTATTAGTGGTAGTGGTGGTAGCAC<br>ATACTACGCAGACTCCGTGAAGGGCCGGTTCACCATCTCCAGA<br>GACAATTCCAAGAACACGCTGTATCTGCAGATGAACAGCCTGA<br>GAGCCGAGGACACGGCCGTATATTACTGTGCGCGTGTTTTCTA<br>CCGTGGTGGTGTTTCTATGGACTACTGGGGCCAAGGAACCCTG<br>GTCACCGTCTCGAGTGCTAGCACCAAGGGCCCATCGGTCTTCC<br>CCCTGGCACCCTCCTCCAAGAGCACCTCTGGGGGCACAGCGGC<br>CCTGGGCTGCCTGGTCAAGGACTACTTCCCCGAACCGGTGACG<br>GTGTCGTGGAACTCAGGCGCCCTGACCAGCGGCGTGCACACCT<br>TCCCGGCTGTCCTACAGTCCTCAGGACTCTACTCCCTCAGCAGC<br>GTGGTGACCGTGCCCTCCAGCAGCTTGGGCACCCAGACCTACA<br>TCTGCAACGTGAATCACAAGCCCAGCAACACCAAGGTGGACA<br>AGAAAGTTGAGCCCAAATCTTGTGACAAAACTCACACATGCCC<br>ACCGTGCCCAGCACCTGAAGCTGCAGGGGGACCGTCAGTCTTC<br>CTCTTCCCCCCAAAACCCAAGGACACCCTCATGATCTCCCGGA<br>CCCCTGAGGTCACATGCGTGGTGGTGGACGTGAGCCACGAAGA<br>CCCTGAGGTCAAGTTCAACTGGTACGTGGACGGCGTGGAGGTG<br>CATAATGCCAAGACAAAGCCGCGGGAGGAGCAGTACAACAGC<br>ACGTACCGTGTGGTCAGCGTCCTCACCGTCCTGCACCAGGACT<br>GGCTGAATGGCAAGGAGTACAAGTGCAAGGTCTCCAACAAAG<br>CCCTCGGCGCCCCCATCGAGAAAACCATCTCCAAAGCCAAAGG<br>GCAGCCCCGAGAACCACAGGTGTACACCCTGCCCCCATCCCGG<br>GATGAGCTGACCAAGAACCAGGTCAGCCTGACCTGCCTGGTCA<br>AAGGCTTCTATCCCAGCGACATCGCCGTGGAGTGGGAGAGCAA<br>TGGGCAGCCGGAGAACAACTACAAGACCACGCCTCCCGTGCTG<br>GACTCCGACGGCTCCTTCTTCCTCTACAGCAAGCTCACCGTGG<br>ACAAGAGCAGGTGGCAGCAGGGGAACGTCTTCTCATGCTCCGT<br>GATGCATGAGGCTCTGCACAACCACTACACGCAGAAGAGCCTC<br>TCCCTGTCTCCGGGTAAA |
| | 206 (Light chain) | SSELTQDPAVSVALGQTVRITCQGDSLRSYYASWYQQKPGQAPV<br>LVIYGKNNRPSGIPDRFSGSSSGNTASLTITGAQAEDEADYYCNSR<br>VMPHNRVFGGGTKLTVLGQPKAAPSVTLFPPSSEELQANKATLVC<br>LISDFYPGAVTVAWKADSSPVKAGVETTTPSKQSNNKYAASSYLS<br>LTPEQWKSHRSYSCQVTHEGSTVEKTVAPTECS |
| | 207 (Heavy chain) | EVQLLESGGGLVQPGGSLRLSCAASGFTFSSYAMSWVRQAPGKG<br>LEWVSAISGSGGSTYYADSVKGRFTISRDNSKNTLYLQMNSLRAE<br>DTAVYYCARVFYRGGVSMDYWGQGTLVTVSSASTKGPSVFPLAP<br>SSKSTSGGTAALGCLVKDYFPEPVTVSWNSGALTSGVHTFPAVLQ<br>SSGLYSLSSVVTVPSSSLGTQTYICNVNHKPSNTKVDKKVEPKSCD<br>KTHTCPPCPAPEAAGGPSVFLFPPKPKDTLMISRTPEVTCVVVDVS<br>HEDPEVKFNWYVDGVEVHNAKTKPREEQYNSTYRVVSVLTVLH<br>QDWLNGKEYKCKVSNKALGAPIEKTISKAKGQPREPQVYTLPPSR<br>DELTKNQVSLTCLVKGFYPSDIAVEWESNGQPENNYKTTPPVLDS<br>DGSFFLYSKLTVDKSRWQQGNVFSCSVMHEALHNHYTQKSLSLS<br>PGK |

The anti-Ox40 antibodies were produced by co-transfecting HEK293-EBNA cells with the mammalian expression vectors using polyethylenimine. The cells were transfected with the corresponding expression vectors in a 1:1 ratio ("vector heavy chain": "vector light chain").

For production in 500 mL shake flasks, 400 million HEK293 EBNA cells were seeded 24 hours before transfection. For transfection cells were centrifuged for 5 minutes at 210×g, and the supernatant was replaced by pre-warmed CD CHO medium. Expression vectors (200 µg of total DNA) were mixed in 20 mL CD CHO medium. After addition of 540 µL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% $CO_2$ atmosphere. After the incubation, 160 mL of F17 medium was added and cells were cultured for 24 hours. One day after transfection 1 mM valproic acid and 7% Feed with supplements were added. After culturing for 7 days, the supernatant was collected by centrifugation for 15 minutes at 210×g. The solution was sterile filtered (0.22 μm filter), supplemented with sodium azide to a final concentration of 0.01% (w/v), and kept at 4° C.

Purification of antibody molecules from cell culture supernatants was carried out by affinity chromatography using Protein A as described above for purification of antigen Fc fusions.

The protein was concentrated and filtered prior to loading on a HiLoad Superdex 200 column (GE Healthcare) equilibrated with 20 mM Histidine, 140 mM NaCl solution of pH 6.0.

The protein concentration of purified antibodies was determined by measuring the OD at 280 nm, using the molar extinction coefficient calculated on the basis of the amino acid sequence. Purity and molecular weight of the antibodies were analyzed by CE-SDS in the presence and absence of a reducing agent (Invitrogen, USA) using a LabChipGXII (Caliper). The aggregate content of antibody samples was analyzed using a TSKgel G3000 SW XL analytical size-exclusion column (Tosoh) equilibrated in a 25 mM $K_2HPO_4$, 125 mM NaCl, 200 mM L-Arginine Monohydrocloride, 0.02% (w/v) $NaN_3$, pH 6.7 running buffer at 25° C.

Table 14 summarizes the yield and final content of the anti-Ox40 P329G LALA IgG1 antibodies.

Example 2

Characterization of Anti-OX40 Antibodies 2.1 Binding on Human OX40
2.1.1 Surface Plasmon Resonance (Avidity+Affinity)

Binding of phage-derived OX40-specific antibodies to the recombinant OX40 Fc(kih) was assessed by surface plasmon resonance (SPR). All SPR experiments were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany).

In the same experiment, the species selectivity and the avidity of the interaction between the phage display derived anti-OX40 clones 8H9, 49B4, 1G4, 20B7, CLC-563, CLC-564 and 17A9 (all human IgG1 P329GLALA), and recombinant OX40 (human, cyno and murine) was determined. Biotinylated human, cynomolgus and murine OX40 Fc(kih) were directly coupled to different flow cells of a streptavidin (SA) sensor chip. Immobilization levels up to 600 resonance units (RU) were used.

Phage display derived anti-OX40 human IgG1 P329GLALA antibodies were passed at a concentration range from 2 to 500 nM (3-fold dilution) with a flow of 30 μL/minute through the flow cells over 120 seconds. Complex dissociation was monitored for 210 seconds. Bulk refractive index differences were corrected for by subtracting the response obtained in a reference flow cell, where no protein was immobilized.

Kinetic constants were derived using the Biacore T200 Evaluation Software (vAA, Biacore AB, Uppsala/Sweden), to fit rate equations for 1:1 Langmuir binding by numerical integration and used to estimate qualitatively the avidity (Table 16).

In the same experiment, the affinities of the interaction between phage display derived antibodies 8H9, 49B4, 1G4, 20B7, CLC-563 and CLC-564 (human IgG1 P329GLALA) to recombinant OX40 were determined. For this purpose, the ectodomain of human or murine Ox40 was also subcloned in frame with an avi (GLNDIFEAQKIEWHE) and a hexahis-

TABLE 14

Biochemical analysis of anti-Ox40 P329G LALA IgG1 clones

| Clone | Yield [mg/l] | Monomer [%] | CE-SDS (non red) | CE-SDS (red) |
|---|---|---|---|---|
| 8H9 P329GLALA IgG1 | 7 | 100 | 1.2% (176 kDa)<br>96.1% (158 kDa)<br>1.3% (142 kDa) | 66.9% (54 kDa)<br>28.9% (25 kDa) |
| 49B4 P329GLALA IgG1 | 7.5 | 100 | 99% (163 kDa)<br>1% (149 kDa) | 81% (61.7 kDa)<br>18% (28.9 kDa) |
| 1G4 P329GLALA IgG1 | 1 | 100 | 98.9% (167.4 kDa)<br>1.1% (151 kDa) | 80% (63.4 kDa)<br>19% (28.9 kDa) |
| 20B7 P329GLALA IgG1 | 17 | 93 | 97.9% (174 kDa) | 79.8% (65.4 kDa)<br>19.9% (29.5 kDa) |
| CLC-563 P329GLALA IgG1 | 6.2 | 100 | 97.7% (160 kDa) | 77.7% (60 kDa)<br>19.8% (26.4 kDa) |
| CLC-564 P329GLALA IgG1 | 13.5 | 100 | 98.4% (155 kDa) | 79.3% (60.1 kDa)<br>19.8% (26.5 kDa) |
| 17A9 P329GLALA IgG1 | 7.5 | 100 | 98.6% (175 kDa)<br>1.4% (153 kDa) | 74.1% (61 kDa)<br>25.5% (38 kDa) | tidine tag (for the sequences see Table 15) or obtained by cleavage with AcTEV protease and removal of Fc by chromatographical method.

TABLE 15

Nucleotide and amino acid sequences of monomeric human and murine OX40 His tag

| SEQ ID NO: | Antigen | Sequence |
|---|---|---|
| 208 | human OX40 His | nucleotide sequence |
| 209 | human OX40 His | LHCVGDTYPSNDRCCHECRPGNGMVSRCSRSQNTVCRPC GPGFYNDVVSSKPCKPCTWCNLRSGSERKQLCTATQDTV CRCRAGTQPLDSYKPGVDCAPCPPGHFSPGDNQACKPWT NCTLAGKHTLQPASNSSDAICEDRDPPATQPQETQGPPAR PITVQPTEAWPRTSQGPSTRPVEVPGGRAVDEQLYFQGGS GLNDIFEAQKIEWHEARAHHHHHH |
| 210 | murine OX40 His | nucleotide sequence |
| 211 | murine OX40 His | TARRLNCVKHTYPSGHKCCRECQPGHGMVSRCDHTRDT LCHPCETGFYNEAVNYDTCKQCTQCNHRSGSELKQNCTP TQDTVCRCRPGTQPRQDSGYKLGVDCVPCPPGHFSPGNN QACKPWTNCTLSGKQTRHPASDSLDAVCEDRSLLATLL WETQRPTFRPTTVQSTTVWPRTSELPSPPTLVTPEGPVDE QLYFQGGSGLNDIFEAQKIEWHEARAHHHHHH |

Protein production was performed as described above for the Fc-fusion protein. Secreted proteins were purified from cell culture supernatants by chelating chromatography, followed by size exclusion chromatography.

The first chromatographic step was performed on a NiNTA Superflow Cartridge (5 ml, Qiagen) equilibrated in 20 mM sodium phosphate, 500 nM sodium chloride, pH7.4. Elution was performed by applying a gradient over 12 column volume from 5% to 45% of elution buffer (20 mM sodium phosphate, 500 nM sodium chloride, 500 mM Imidazole, pH7.4).

The protein was concentrated and filtered prior to loading on a HiLoad Superdex 75 column (GE Healthcare) equilibrated with 2 mM MOPS, 150 mM sodium chloride, 0.02% (w/v) sodium azide solution of pH 7.4.

Affinity determination was performed using two setups.

Setup 1) Anti-human Fab antibody (Biacore, Freiburg/Germany) was directly coupled on a CM5 chip at pH 5.0 using the standard amine coupling kit (Biacore, Freiburg/Germany). The immobilization level was approximately 9000 RU. Phage display derived antibodies to OX40 were captured for 60 seconds at concentrations of 25 to 50 nM. Recombinant human OX40 Fc(kih) was passed at a concentration range from 4 to 1000 nM with a flow of 30 µL/minutes through the flow cells over 120 seconds. The dissociation was monitored for 120 seconds. Bulk refractive index differences were corrected for by subtracting the response obtained on reference flow cell. Here, the antigens were flown over a surface with immobilized anti-human Fab antibody but on which HBS-EP has been injected rather than the antibodies.

Setup 2) Anti-human Fc antibody (Biacore, Freiburg/Germany) was directly coupled on a CM5 chip at pH 5.0 using the standard amine coupling kit (Biacore, Freiburg/Germany). The immobilization level was approximately 8000 RU. Phage display derived antibodies to Ox40 were captured for 60 seconds at concentrations of 20 nM. Recombinant human Ox40 avi His was passed at a concentration range from 2.3 to 600 nM with a flow of 30 µL/minutes through the flow cells over 120 seconds. The dissociation was monitored for 120 seconds. Bulk refractive index differences were corrected for by subtracting the response obtained on reference flow cell. Here, the antigens were flown over a surface with immobilized anti-human Fab antibody but on which HBS-EP has been injected rather than the antibodies.

Kinetic constants were derived using the Biacore T200 Evaluation Software (vAA, Biacore AB, Uppsala/Sweden), to fit rate equations for 1:1 Langmuir binding by numerical integration.

Clones 49B4, 1G4 and CLC-564 bind human Ox40 Fc(kih) with a lower affinity than clones 8H9, 20B7 and CLC-563.

Affinity constants for the interaction between anti-OX40 P329GLALA IgG1 and human OX40 Fc(kih) were determined by fitting to a 1:1 Langmuir binding.

TABLE 16

Binding of anti-OX40 antibodies to recombinant human OX40

| Clone | Recombinant human OX40 (avidity format) | Recombinant human OX40 Fc(kih) (affinity format) | | | Recombinant human OX40 His (affinity format) | | |
|---|---|---|---|---|---|---|---|
| | | ka (1/Ms) | kd (1/s) | KD (M) | ka (1/Ms) | kd (1/s) | KD (M) |
| 8H9 | ++++ | 1.6E+05 | 4.5E−03 | 2.8E−08 | 6.5E+04 | 2.0E−03 | 3.1E−08 |
| 49B4 | ++ | 2.5E+05 | 1.3E−01 | 5.1E−07 | 1.4E+06 | 6.7E−01 | 4.6E−07 |
| 1G4 | ++ | 3.0E+05 | 8.4E−08 | 2.8E−07 | 2.3E+06 | 5.7E−01 | 2.5E−07 |
| 20B7 | +++ | 3.2E+04 | 1.3E−03 | 4.2E−08 | 1.2E+05 | 6.6E−04 | 5.6E−09 |

TABLE 16-continued

Binding of anti-OX40 antibodies to recombinant human OX40

| Clone | Recombinant human OX40 (avidity format) | Recombinant human OX40 Fc(kih) (affinity format) | | | Recombinant human OX40 His (affinity format) | | |
|---|---|---|---|---|---|---|---|
| | | ka (1/Ms) | kd (1/s) | KD (M) | ka (1/Ms) | kd (1/s) | KD (M) |
| CLC-563 | ++ | 3.6E+04 | 3.2E−03 | 8.9E−08 | 4.0E+04 | 3.6E−03 | 8.9E−08 |
| CLC-564 | ++++ | 3.2E+04 | 4.2E−03 | 1.3E−07 | 3.8E+05 | 5.3E−03 | 1.4E−08 |

2.1.2 Binding to Human Ox40 Expressing Cells: Naïve and Activated Human Peripheral Mononuclear Blood Leukocytes (PBMC)

Buffy coats were obtained from the Zurich blood donation center. To isolate fresh peripheral blood mononuclear cells (PBMCs) the buffy coat was diluted with the same volume of DPBS (Gibco by Life Technologies, Cat. No. 14190 326). 50 mL polypropylene centrifuge tubes (TPP, Cat.-No. 91050) were supplied with 15 mL Histopaque 1077 (SIGMA Life Science, Cat.-No. 10771, polysucrose and sodium diatrizoate, adjusted to a density of 1.077 g/mL) and the buffy coat solution was layered above the Histopaque 1077. The tubes were centrifuged for 30 min at 400×g, room temperature and with low acceleration and no break. Afterwards the PBMCs were collected from the interface, washed three times with DPBS and resuspended in T cell medium consisting of RPMI 1640 medium (Gibco by Life Technology, Cat. No. 42401-042) supplied with 10% Fetal Bovine Serum (FBS, Gibco by Life Technology, Cat. No. 16000-044, Lot 941273, gamma-irradiated, mycoplasma-free and heat inactivated at 56° C. for 35 min), 1% (v/v) GlutaMAX I (GIBCO by Life Technologies, Cat. No. 35050 038), 1 mM Sodium-Pyruvat (SIGMA, Cat. No. S8636), 1% (v/v) MEM non-essential amino acids (SIGMA, Cat.-No. M7145) and 50 µM β-Mercaptoethanol (SIGMA, M3148).

PBMCs were used directly after isolation (binding on naïve human PBMCs) or they were stimulated to receive a strong human Ox40 expression on the cell surface of T cells (binding on activated human PBMCs). Therefore naïve PBMCs were cultured for five days in T cell medium supplied with 200 U/mL Proleukin and 2 ug/mL PHA-L in 6-well tissue culture plate and then 1 day on pre-coated 6-well tissue culture plates [2 ug/mL anti-human CD3 (clone OKT3) and 2 ug/mL anti-human CD28 (clone CD28.2)] in T cell medium supplied with 200 U/mL Proleukin at 37° C. and 5% $CO_2$.

For detection of Ox40 naïve human PBMC and activated human PBMC were mixed. To enable distinction of naïve from activated human PBMC resting cells were labeled prior to the binding assay using the eFluor670 cell proliferation dye (eBioscience, Cat.-No. 65-0840-85).

For labeling cells were harvested, washed with pre-warmed (37° C.) DPBS and adjusted to a cell density of $1 \times 10^7$ cells/mL in DPBS. eFluor670 cell proliferation dye (eBioscience, Cat.-No. 65-0840-85) was added to the suspension of naïve human PBMC at a final concentration of 2.5 mM and a final cell density of $0.5 \times 10^7$ cells/mL in DPBS. Cells were then incubated for 10 min at room temperature in the dark. To stop labeling reaction 2 mL FBS were added and ells were washed three times with T cell medium. A one to one mixture of $1 \times 10^5$ naïve, eFluor670 labeled human PBMC and unlabeled activated human PBMC were then added to each well of a round-bottom suspension cell 96-well plates (Greiner bio-one, cellstar, Cat. No. 650185).

Plates were centrifuged 4 minutes with 400×g and at 4° C. and supernatant was flicked off. Cell were washed once with 200 µL 4° C. cold FACS buffer (DPBS supplied with 2% FBS, 5 mM EDTA pH8 (Amresco, Cat. No. E177) and 7.5 mM Sodium azide (Sigma-Aldrich S2002)). Cells were incubated in 50 µL/well of 4° C. cold FACS buffer containing titrated anti-Ox40 antibody constructs for 120 minutes at 4° C. Plates were washed four times with 200 µL/well 4° C. FACS buffer to remove unbound construct.

Cells were stained for 30 minutes at 4° C. in the dark in 25 µL/well 4° C. cold FACS buffer containing fluorescently labeled anti-human CD4 (clone RPA-T4, mouse IgG1 k, BioLegend, Cat.-No. 300532), anti-human CD8 (clone RPa-T8, mouse IgG1k, BioLegend, Cat.-No. 3010441), anti-human CD45 (clone HI30, mouse IgG1k, BioLegend, Cat.-No. 304028), and Fluorescein isothiocyanate (FITC)-conjugated AffiniPure anti-human IgG Fcγ-fragment-specific goat IgG F(ab')$_2$ fragment (Jackson ImmunoResearch, Cat.-No. 109-096-098).

Plates where washed twice with 200 µL/well 4° C. FACS buffer, were finally resuspended in 80 µL/well FACS-buffer containing 0.2 µg/mL DAPI (Santa Cruz Biotec, Cat. No. Sc-3598) and acquired the same day using 5-laser LSR-Fortessa (BD Bioscience with DIVA software).

As shown in FIGS. 2A-2D, no antibody construct specific for OX40 bound to resting human CD4$^+$ T-cells or CD8$^+$ T-cells, which do not express OX40. In contrast, all constructs bound to activated CD8$^+$ or CD4$^+$ T-cells, which do express OX40. Binding to CD4$^+$ T-cells was much stronger than that to CD8$^+$ T cells. Activated human CD8$^+$ T cells do express only a fraction of the OX40 levels detected on activated CD4$^+$ T cells. The difference is donor as well as time dependent. The analyzed anti-OX40 clones varied in their binding strength. The $EC_{50}$ values are shown in Table 17. For further evaluation of bivalent and monovalent FAP targeted constructs clones with high (8H9) and low (49B4/1G4) binding capacity were chosen.

TABLE 17

$EC_{50}$ values of binding to activated human CD4 T cells

| Clone | $EC_{50}$ [nM] |
|---|---|
| 8H9 | 0.59 |
| CLC563 | 1.59 |
| 20B7 | 1.64 |
| 49B4 | 4.19 |
| CLC-564 | 4.63 |
| 1G4 | n.a. |

2.2 Binding on Murine OX40
2.2.1 Surface Plasmon Resonance (Avidity+Affinity)

Binding of the phage-derived OX40 specific antibody 20B7 to recombinant murine OX40 Fc(kih) was assessed by surface plasmon resonance as described above for human OX40 Fc(kih) (see Example 2.1.1). Kinetic constants were derived using the Biacore T200 Evaluation Software (vAA, Biacore AB, Uppsala/Sweden), to fit rate equations for 1:1 Langmuir binding by numerical integration and used to estimate qualitatively the avidity (Table 18).

For affinity determination, due to an unspecific interaction of the Fc fusion protein to the reference flow cell, murine Ox40 His (see Example 2.1.2) or Ox40 Fc(kih) cleaved with AcTEV protease was used. Anti-human Fc antibody (Biacore, Freiburg/Germany) was directly coupled on a CM5 chip at pH 5.0 using the standard amine coupling kit (Biacore, Freiburg/Germany). The immobilization level was approximately 8000 RU. Phage display derived antibodies to OX40 were captured for 60 seconds at concentrations of 25 nM. Recombinant murine OX40 (cleaved by AcTEV digestion following the distributor instruction) was passed at a concentration range from 4.1 to 1000 nM with a flow of 30 μL/minutes through the flow cells over 120 seconds. The dissociation was monitored for 120 seconds. Bulk refractive index differences were corrected for by subtracting the response obtained on reference flow cell. Here, the antigens were flown over a surface with immobilized anti-human Fab antibody but on which HBS-EP has been injected rather than the antibodies.

Kinetic constants were derived using the Biacore T200 Evaluation Software (vAA, Biacore AB, Uppsala/Sweden), to fit rate equations for 1:1 Langmuir binding by numerical integration. It was shown that clone 20B7 binds murine OX40 (Table 18).

Affinity constants of interaction between anti-OX40 P329GLALA IgG1 molecules and murine OX40 were derived using the Biacore T200 Evaluation Software (vAA, Biacore AB, Uppsala/Sweden), to fit rate equations for 1:1 Langmuir binding by numerical integration.

TABLE 18

Binding of anti-Ox40 antibody 20B7 to murine OX40

| Clone | Origin | Recombinant murine OX40 (avidity format) | Recombinant murine OX40 (affinity format) | | |
|-------|--------|------------------------------------------|-------|-------|-------|
|       |        |                                          | ka (1/Ms) | kd (1/s) | KD (M) |
| 20B7  | Phage display | ++ | 4.9E+04 | 1.8E-02 | 3.6E-07 |

2.2.2 Binding to Mouse OX40 Expressing Cells: Naïve and Activated Mouse Splenocytes (Selected Clones)

Mouse spleens were collected in 3 mL PBS and a single cell suspension was generated using the gentle MACS tubes (Miltenyi Biotec Cat.-No. 130-096-334) and gentleMACS Octo Dissociator (Miltenyi Biotec). Afterwards splenocytes were filtered through a 30 μm pre-separation filters (Miltenyi Biotec Cat.-No. 130-041-407) and centrifuged for 7 min at 350×g and 4° C. Supernatant was aspirated and cells were resuspended in RPMI 1640 medium supplied with 10% (v/v) FBS, 1% (v/v) GlutaMAX-I, 1 mM Sodium-Pyruvate, 1% (v/v) MEM non-essential amino acids, 50 μM β-Mercaptoethanol and 10% Penicillin-Streptomycin (SIGMA, Cat.-No. P4333). $10^6$ cells/mL were cultured for 3 days in a 6-well tissue culture plate coated with 10 μg/mL anti-mouse CD3ε Armenian hamster IgG (clone 145-2C11, BioLegend, Cat.-No. 100331) and 2 μg/mL anti-mouse CD28 Syrian hamster IgG (clone 37.51, BioLegend, Cat.-No. 102102). Activated or fresh mouse splenocytes were harvested, washed in DPBS, counted and $0.1 \times 10^6$ cells were transferred to each well of a 96 U-bottom non-tissue culture treated well plate. Cells were washed with DPBS and stained in 50 uL FACS buffer containing different concentration of anti-OX40 human IgG1 P329GLALA antibodies (selected binders only). Cells were incubated for 120 min at 4° C. Then cells were washed twice with FACS buffer and stained in 25 FACS buffer containing anti-mouse CD8b rat IgG2bκ-APC-Cy7 (BioLegend, Cat.-No. 100714, clone53-6.7), anti-mouse CD4 rat IgG2bκ-PE-Cy7 (BioLegend, Cat.-No. 100422, clone GK1.5) and FITC-conjugated AffiniPure anti-human IgG Fcγ-fragment-specific goat IgG F(ab')$_2$ fragment (Jackson ImmunoResearch, Cat.-No. 109-096-098) for 30 min at 4° C. Plates where washed twice with 200 μL/well 4° C. FACS buffer, were finally resuspended in 80 μL/well FACS-buffer containing 0.2 μg/mL DAPI (Santa Cruz Biotec, Cat. No. Sc-3598) and acquired the same day using 5-laser LSR-Fortessa (BD Bioscience with DIVA software).

As shown in FIGS. 3A-3D only clone 20B7 and the well characterized mouse specific benchmark antibody OX86 showed binding to activated mouse CD4$^+$ and CD8$^+$ T cells. No binding was observed on resting mouse splenocytes.

2.3 Binding on Cynomolgus OX40

To test the reactivity of selected anti-OX40 binders with cynomolgus cells, PBMC of healthy *Macaca fascicularis* were isolated from heparinized blood using density gradient centrifugation as described for human cells with minor modifications. Cynomolgus PBMC were isolated with density gradient centrifugation from heparinized fresh blood using lymphoprep medium (90% v/v, Axon Lab, Cat. No. 1114545) diluted with DPBS. Centrifugation was performed at 520×g, without brake at room temperature for 30 minutes. Adjacent centrifugation at 150×g at room temperature for 15 minutes was performed to reduce platelets count followed by several centrifugation steps with 400×g at room temperature for 10 minutes to wash PBMC with sterile DPBS. PBMCs were stimulated to receive a strong Ox40 expression on the cell surface of T cells (binding on activated cynomolgus PBMCs). Therefore naïve PBMCs were cultured for 72 hrs on pre-coated 12-well tissue culture plates [10 ug/mL cynomolgus cross-reactive anti-human CD3 (clone clone SP34)] and 2 ug/mL cynomolgus cross-reactive anti-human CD28 (clone CD28.2)] in T cell medium supplied with 200 U/mL Proleukin at 37° C. and 5% $CO_2$.

$0.5 \times 10^5$ activated cynomolgus PBMC were then added to each well of a round-bottom suspension cell 96-well plates (greiner bio-one, cellstar, Cat. No. 650185). Cell were washed once with 200 μL 4° C. cold FACS buffer and were incubated in 50 μL/well of 4° C. cold FACS containing titrated anti-Ox40 antibody constructs for 120 minutes at 4° C. Then, plates were washed four times with 200 μL/well 4° C. FACS buffer. Cells were resuspended in 25 μL/well 4° C. cold FACS buffer containing fluorescently labeled, cynomolgus cross-reactive anti-human CD4 (clone OKT-4, mouse IgG1 k, BD, Cat.-No. 317428), anti-human CD8 (clone HIT8a, mouse IgG1k, BD, Cat.-No. 555369) and FITC-conjugated AffiniPure anti-human IgG Fcγ-fragment-specific goat IgG F(ab')$_2$ fragment (Jackson ImmunoResearch, Cat.-No. 109-096-098) and incubated for 30 minutes at 4° C. in the dark. Plates where washed twice with 200 μL/well 4° C. FACS buffer, were finally resuspended in 80 μL/well FACS-buffer containing 0.2 μg/mL DAPI (Santa Cruz Biotec, Cat. No. Sc-3598) and acquired the same day using 5-laser LSR-Fortessa (BD Bioscience with DIVA software).

Figure 4A:
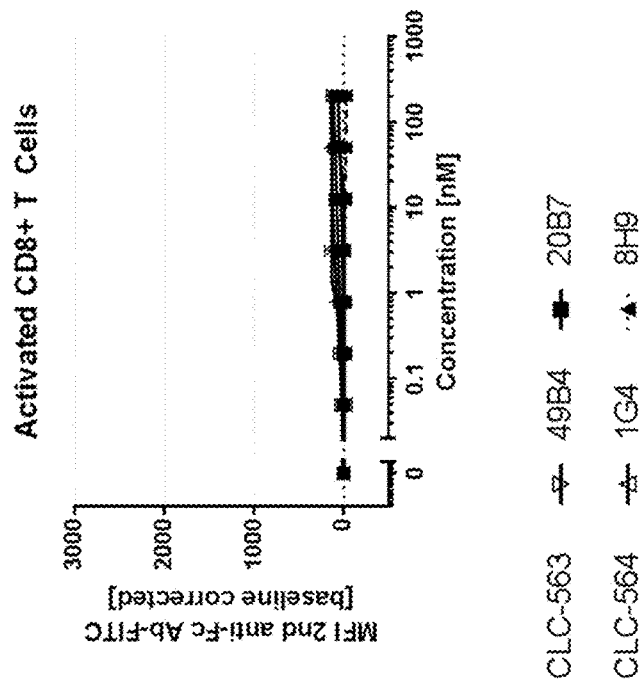
FIGS. 4A and 4B show the binding of anti-OX40 antibodies on cynomolgus activated CD4$^+$ and CD8$^+$ T cells. The depicted clones varied in their binding strength (EC$_{50}$ values as well as signal strength) to OX40 positive activated cynomolgus CD4$^+$ T cells (FIG. 4A). OX40 expression on activated CD8$^+$ T cells is low under this condition and hardly any binding of the selected clones was found (FIG. 4B). Binding of anti-OX40 antibodies to cell surface proteins was detected with a goat anti-human IgG Fc-specific secondary antibody conjugated to FITC using FACS analysis. MFI was measured by flow cytometry and baseline corrected by subtracting the MFI of the blank control. The x-axis shows the concentration of antibody constructs. All OX40 clones do bind to activated, OX40 expressing cynomolgus CD4$^+$ T cells, and to a lower extent to activated cynomolgus CD8$^+$ T cells.
Figure 4B:
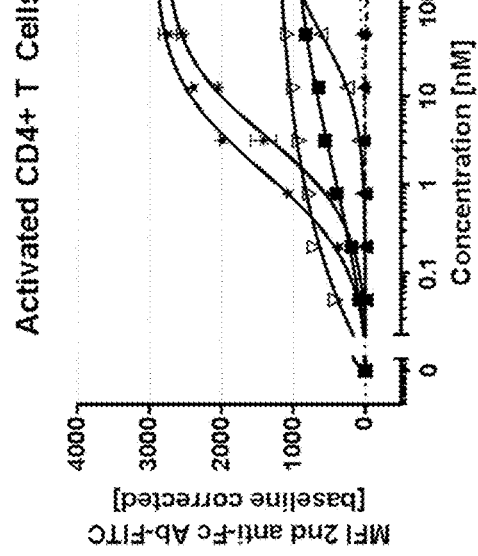

As shown in FIGS. 4A and 4B, most constructs bound to activated CD4$^+$ cynomolgus T-cells. Binding to CD4$^+$ T-cells was much stronger than that to CD8$^+$ T cells.

Expression levels for OX40 are depending on kinetic and strength of stimulation and were optimized for CD4+ cynomolgus T cells but not for CD8+ cynomolgus T cells, so that only little OX40 expression was induced on CD8+ T cells. The analyzed anti-OX40 clones varied in their binding strength. The $EC_{50}$ values are shown in Table 19. Due to untypical curve fit no $EC_{50}$ value could be calculated for clones 8H9, 49B4, 21H4.

TABLE 19

$EC_{50}$ values of binding to activated cynomolgus CD4 T cells

| Clone | $EC_{50}$ [nM] |
| --- | --- |
| 8H9 | n.d. |
| CLC563 | 1.41 |
| 20B7 | 1.52 |
| 49B4 | n.d. |
| CLC-564 | 3.50 |
| 1G4 | 48.20 |

2.3.1 Surface Plasmon Resonance (Avidity+Affinity)

Binding of phage-derived OX40-specific antibodies (all human IgG1 P329GLALA) to the recombinant cynomolgus OX40 Fc(kih) was assessed by surface plasmon resonance (SPR). All SPR experiments were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany).

Biotinylated cynomolgus OX40 Fc(kih) was directly coupled to different flow cells of a streptavidin (SA) sensor chip. Immobilization levels up to 800 resonance units (RU) were used.

Phage display derived anti-OX40 human IgG1 P329GLALA antibodies were passed at a concentration range from 2 to 500 nM (3-fold dilution) with a flow of 30 μL/minute through the flow cells over 120 seconds. Complex dissociation was monitored for 210 seconds. Bulk refractive index differences were corrected for by subtracting the response obtained in a reference flow cell, where no protein was immobilized.

Kinetic constants were derived using the Biacore T200 Evaluation Software (vAA, Biacore AB, Uppsala/Sweden), to fit rate equations for 1:1 Langmuir binding by numerical integration and used to estimate qualitatively the avidity (Table 20).

In the same experiment, the affinities of the interaction between phage display derived antibodies (human IgG1 P329GLALA) to recombinant cynomolgus OX40 Fc(kih) were determined. Anti-human Fab antibody (Biacore, Freiburg/Germany) was directly coupled on a CM5 chip at pH 5.0 using the standard amine coupling kit (Biacore, Freiburg/Germany). The immobilization level was approximately 9000 RU. Phage display derived antibodies to Ox40 were captured for 60 seconds at concentrations of 25 to 50 nM. Recombinant cynomolgus Ox40 Fc(kih) was passed at a concentration range from 4 to 1000 nM with a flow of 30 μL/minutes through the flow cells over 120 seconds. The dissociation was monitored for 120 seconds. Bulk refractive index differences were corrected for by subtracting the response obtained on reference flow cell. Here, the antigens were flown over a surface with immobilized anti-human Fab antibody but on which HBS-EP has been injected rather than the antibodies.

Kinetic constants were derived using the Biacore T200 Evaluation Software (vAA, Biacore AB, Uppsala/Sweden), to fit rate equations for 1:1 Langmuir binding by numerical integration (Table 20).

Clones 49B4, 1G4 and CLC-564 bind cynomolgus OX40 Fc(kih) with a lower affinity than clones 8H9, 20B7 and CLC-563.

Affinity constants of interaction between anti-OX40 P329GLALA IgG1 and cynomolgus OX40 Fc(kih) were derived using the Biacore T100 Evaluation Software (vAA, Biacore AB, Uppsala/Sweden), to fit rate equations for 1:1 Langmuir binding by numerical integration.

TABLE 20

Binding of anti-OX40 antibodies to recombinant cynomolgus OX40 Fc(kih)

| Clone | Origin | Recombinant cynomolgus OX40 (avidity format) | Recombinant cynomolgus OX40 (affinity format) | | |
| --- | --- | --- | --- | --- | --- |
| | | | ka (1/Ms) | kd (1/s) | KD (M) |
| 8H9 | Phage display | ++++ | 1.4E+05 | 9.6E-02 | 6.7E-07 |
| 20B7 | Phage display | +++ | 1.57E+04 | 1.66E-02 | 1.1E-06 |
| 49B4 | Phage display | ++ | 1.1E+05 | 3.8E-02 | 3.5E-07 |
| 1G4 | Phage display | + | Too low to be detected | | |
| CLC-563 | Phage display | +++ | 2.8E+04 | 6.9E-04 | 2.5E-08 |
| CLC-564 | Phage display | +++ | 2.1E+04 | 7.2E-04 | 3.4E-08 |

2.3.2 Binding on Cynomolgus OX40 Expressing Cells: Activated Cynomolgus Peripheral Mononuclear Blood Leukocytes (PBMC)

Binding to OX40 Negative Tumor Cells

The lack of binding to OX40 negative tumor cells was tested using WM266-4 cells (ATCC CRL-1676) and U-87 MG (ATCC HTB-14) tumor cells. To allow separation of both tumor cells, WM266-4 cells were pre-labeled with PKH-26 Red Fluorescence Cell linker Kit (Sigma, Cat.-No. PKH26GL). Cells were harvested and washed three times with RPMI 1640 medium. Pellet was stained for 5 minutes at room temperature in the dark at a final cell density of $1 \times 10^7$ cells in freshly prepared PKH26-Red-stain solution (final concentration [1 nM] in provided diluent C). Excess FBS was added to stop labeling reaction and cell were washed four times with RPMI 1640 medium supplemented with 10% (v/v) FBS, 1% (v/v) GlutaMAX-I to remove excess dye.

A mixture of $5 \times 10^4$ PKH26 labeled WM266-4 cells and unlabeled U-87 MG cells in DPBS were added to each well of a round-bottom suspension cell 96-well plates. Plates were centrifuged 4 minutes, 400×g, 4° C. and supernatant were flicked off. Cells were washed once with 200 μL DPBS and pellets were resuspended by a short and gentle vortex. All samples were resuspended in 50 μL/well of 4° C. cold FACS buffer containing titrated concentrations of anti-Ox40 human IgG1 P329GLALA antibody constructs for 120 minutes at 4° C. Plates were washed four times with 200 μL/well 4° C. FACS buffer. Cells were resuspended in 25 μL/well 4° C. cold FACS buffer containing FITC-conjugated AffiniPure anti-human IgG Fcγ-fragment-specific goat IgG F(ab')$_2$ fragment (Jackson ImmunoResearch, Cat.-No. 109-096-098) and incubated for 30 minutes at 4° C. in the dark. Plates where washed twice with 200 μL/well 4° C. FACS buffer, were finally resuspended in 80 μL/well FACS-buffer containing 0.2 μg/mL DAPI (Santa Cruz Biotec, Cat. No. Sc-3598) and acquired the same day using 5-laser LSR-Fortessa (BD Bioscience with DIVA software).

Figure 5A:
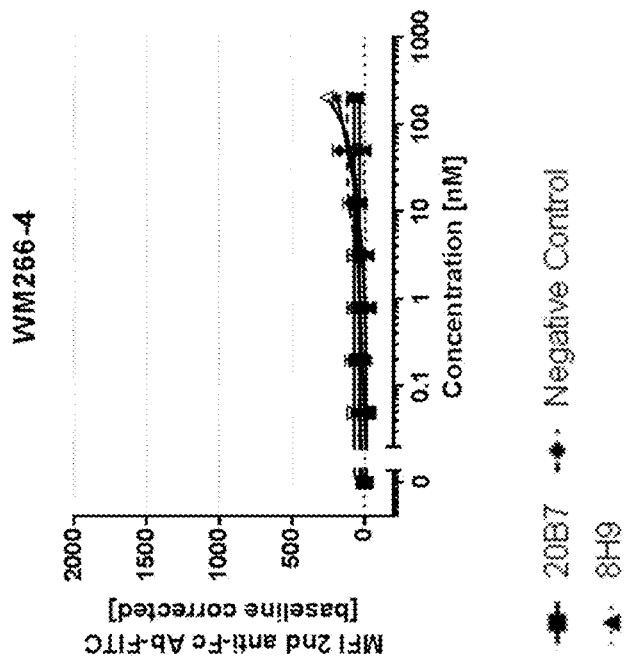
FIGS. 5A and 5B show the lack of binding to OX40 negative tumor cells. The depicted clones showed no binding to OX40 negative U-78 MG (FIG. 5A) and WM266-4 tumor cells (FIG. 5B). Shown is the binding as median of fluorescence intensity (MFI) of FITC labeled anti-human IgG Fcγ-specific goat IgG F(ab')2 fragment which is used as secondary detection antibody. MFI was measured by flow cytometry and baseline corrected by subtracting the MFI of the blank control. The x-axis shows the concentration of antibody constructs. All clones in an IgG format do not bind to OX40 negative tumor cells. Binding is specific for OX40 on activated leukocytes.
Figure 5B:
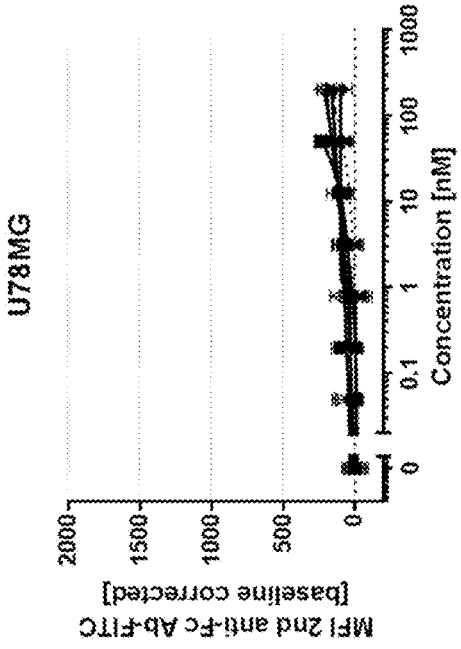

As shown in FIGS. 5A and 5B, no antibody construct specific for OX40 bound to OX40 negative human tumor cells WM266-4 and U-78 MG.

2.4 Ligand Blocking Property

To determine the capacity of OX40-specific human IgG1 P329GLALA antibody molecules to interfere with OX40/OX40-ligand interactions human OX40 ligand (R&D systems) was used. Due to the low affinity of the interaction between OX40 and OX40 ligand, a dimeric human OX40 Fc fusion with a C-terminal Ha tag was prepared (FIG. 1B). The nucleotide and amino acid sequences of this dimeric human Ox40 Fc fusion molecule are shown in Table 21. Production and purification were performed as described for the monomeric OX40 Fc(kih) in Example 1.1.

nM with a flow of 30 μL/minute over 90 seconds. The dissociation was omitted and the phage derived anti-Ox40 human IgG1P329LALA was passed on both flow cells at a concentration of 500 nM with a flow of 30 μL/minute over 90 seconds. The dissociation was monitored for 60 seconds. Bulk refractive index differences were corrected for by subtracting the response obtained on reference flow cell. Here, the antibodies were flown over a surface with immobilized human OX40 ligand but on which HBS-EP has been injected instead of recombinant human OX40 Fc. FIG. 1C shows the design of the experiment.

The phage-derived clone 20B7 bound to the complex of human OX40 with its OX40 ligand (Table 22, FIG. 6B).

TABLE 21 cDNA and Amino acid sequences of dimeric human OX40 Fc fusion molecule (composed by 2 Fc chains)

| SEQ ID NO: | Antigen | Sequence |
|---|---|---|
| 212 | Nucleotide sequence dimeric human OX40 antigen Fc | CTGCACTGCGTGGGCGACACCTACCCCAGCAACGACC GGTGCTGCCACGAGTGCAGACCCGGCAACGGCATGGT GTCCCGGTGCAGCCGGTCCCAGAACACCGTGTGCAGA CCTTGCGGCCCTGGCTTCTACAACGACGTGGTGTCCAG CAAGCCCTGCAAGCCTTGTACCTGGTGCAACCTGCGG AGCGGCAGCGAGCGGAAGCAGCTGTGTACCGCCACCC AGGATACCGTGTGCCGGTGTAGAGCCGGCACCCAGCC CCTGGACAGCTACAAACCCGGCGTGGACTGCGCCCCT TGCCCTCCTGGCCACTTCAGCCCTGGCGACAACCAGG CCTGCAAGCCTTGGACCAACTGCACCCTGGCCGGCAA GCACACCCTGCAGCCCGCCAGCAATAGCAGCGACGCC ATCTGCGAGGACCGGGATCCTCCTGCCACCCAGCCTC AGGAAACCCAGGGCCCTCCCGCCAGACCCATCACCGT GCAGCCTACAGAGGCCTGGCCCAGAACCAGCCAGGGG CCTAGCACCAGACCCGTGGAAGTGCCTGGCGGCAGAG CCGTCGACGAACAGTTATATTTTCAGGGCGGCTCACCC AAATCTGCAGACAAAACTCACACATGCCCACCGTGCC CAGCACCTGAACTCCTGGGGGGACCGTCAGTCTTCCTC TTCCCCCCAAAACCCAAGGACACCCTCATGATCTCCCG GACCCCTGAGGTCACATGCGTGGTGGTGGACGTGAGC CACGAAGACCCTGAGGTCAAGTTCAACTGGTACGTGG ACGGCGTGGAGGTGCATAATGCCAAGACAAAGCCGCG GGAGGAGCAGTACAACAGCACGTACCGTGTGGTCAGC GTCCTCACCGTCCTGCACCAGGACTGGCTGAATGGCA AGGAGTACAAGTGCAAGGTCTCCAACAAAGCCCTCGG CGCCCCCATCGAGAAAACCATCTCCAAAGCCAAAGGG CAGCCCCGAGAACCACAGGTGTACACCCTGCCCCCAT CCCGGGATGAGCTGACCAAGAACCAGGTCAGCCTGAC CTGCCTGGTCAAAGGCTTCTATCCCAGCGACATCGCCG TGGAGTGGGAGAGCAATGGGCAGCCGGAGAACAACT ACAAGACCACGCCTCCCGTGCTGGACTCCGACGGCTC CTTCTTCCTCTACAGCAAGCTCACCGTGGACAAGAGC AGGTGGCAGCAGGGGAACGTCTTCTCATGCTCCGTGA TGCATGAGGCTCTGCACAACCACTACACGCAGAAGAG CCTCTCCCTGTCTCCGGGTAAATCCGGCTACCCATACG ATGTTCCAGATTACGCT |
| 213 | dimeric human OX40 antigen Fc | LHCVGDTYPSNDRCCHECRPGNGMVSRCSRSQNTVCRP CGPGFYNDVVSSKPCKPCTWCNLRSGSERKQLCTATQD TVCRCRAGTQPLDSYKPGVDCAPCPPGHFSPGDNQACKP WTNCTLAGKHTLQPASNSSDAICEDRDPPATQPQETQGP PARPITVQPTEAWPRTSQGPSTRPVEVPGGRAVDEQLYF QGGSPKSADKTHTCPPCPAPELLGGPSVFLFPPKPKDTLM ISRTPEVTCVVVDVSHEDPEVKFNWYVDGVEVHNAKTK PREEQYNSTYRVVSVLTVLHQDWLNGKEYKCKVSNKA LGAPIEKTISKAKGQPREPQVYTLPPSRDELTKNQVSLTC LVKGFYPSDIAVEWESNGQPENNYKTTPPVLDSDGSFFL YSKLTVDKSRWQQGNVFSCSVMHEALHNHYTQKSLSLS PGKSGYPYDVPDYA |

Human OX40 ligand (R&D systems) was directly coupled to two flow cells of a CM5 chip at approximately 2500 RU by pH 5.0 using the standard amine coupling kit (Biacore, Freiburg/Germany). Recombinant human Ox40 Fc was passed on the second flow cell at a concentration of 200

Thus, this antibody does not compete with the ligand for binding to human OX40 and is therefore termed "non-ligand blocking". On the contrary, clones 8H9, 1G4, 49B4, CLC-563 and CLC-564 did not bind to human OX40 in complex with its ligand and are therefore termed "ligand blocking".

TABLE 22

Ligand binding property of the anti-OX40 clones determined by surface plasmon resonance

| Clone | Origin | First injection | Second injection (anti-Ox40 clone) | Ligand blocking |
|---|---|---|---|---|
| 8H9 | Phage display | human OX40 Fc | Not binding | YES |
| 20B7 | Phage display | human OX40 Fc | Binding | NO |
| 1G4 | Phage display | human OX40 Fc | Not binding | YES |
| 49B4 | Phage display | human OX40 Fc | Not binding | YES |
| CLC-564 | Phage display | human OX40 Fc | Not binding | YES |
| CLC-564 | Phage display | human OX40 Fc | Not binding | YES |

Example 3

Functional Properties of Anti-human OX40 Binding Clones 3.1 HeLa Cells Expressing Human OX40 and Reporter Gene NF-κB-luciferase Agonstic binding of OX40 to its ligand induces downstream signaling via activation of nuclear factor kappa B (NFκB) (A. D. Weinberg et al., J. Leukoc. Biol. 2004, 75(6), 962-972). The recombinant reporter cell line HeLa_hOx40_NFkB_Luc1 was generated to express human Ox40 on its surface. Additionally, it harbors a reporter plasmid containing the luciferase gene under the control of an NFκB-sensitive enhancer segment. Ox40 triggering induces dose-dependent activation of NFκB, which translocates in the nucleus, where it binds on the NFκB sensitive enhancer of the reporter plasmid to increase expression of the luciferase protein. Luciferase catalyzes luciferin-oxidation resulting in oxyluciferin which emits light. This can be quantified by a luminometer. The scope of one experiment was to test the capacity of the various anti-Ox40 binders in a P329GLALA huIgG1 format to induce NFκB activation in HeLa_hOx40_NFκB_Luc1 reporter cells.

Adherent HeLa_hOx40_NFκB_Luc1 cells were harvested using cell dissociation buffer (Invitrogen, Cat.-No. 13151-014) for 10 minutes at 37° C. Cells were washed once with DPBS and were adjusted to a cell density of $2 \times 10^5$ in assay media comprising of MEM (Invitrogen, Cat.-No. 22561-021), 10% (v/v) heat-inactivated FBS, 1 mM Sodium-Pyruvat and 1% (v/v) non-essential amino acids. Cells were seeded in a density of $0.3 * 10^5$ cells per well in a sterile white 96-well flat bottom tissue culture plate with lid (greiner bio-one, Cat. No. 655083) and kept over night at 37° C. and 5% $CO_2$ in an incubator (Hera Cell 150).

The next day, HeLa_hOX40_NFkB_Luc1 were stimulated for 6 hours adding assay medium containing various titrated anti-OX40 binders in a P329GLALA huIgG1 format. For testing the effect of hyper-crosslinking on anti-OX40 antibodies, 50 μL/well of medium containing secondary antibody anti-human IgG Fcγ-fragment-specific goat IgG F(ab')$_2$ fragment (Jackson ImmunoResearch, 109-006-098) were added in a 1:2 ratio (2 times more secondary antibody than the primary single anti-OX40 P329GLALA huIgG1). After incubation, supernatant was aspirated and plates washed two times with DPBS. Quantification of light emission was done using the luciferase 1000 assay system and the reporter lysis buffer (both Promega, Cat.-No. E4550 and Cat-No: E3971) according to manufacturer instructions. Briefly, cells were lysed for 10 minutes at −20° C. by addition of 30 uL per well 1× lysis buffer. Cells were thawed for 20 minutes at 37° C. before 90 uL per well provided luciferase assay reagent was added. Light emission was quantified immediately with a SpectraMax M5/M5e microplate reader (Molecular Devices, USA) using 500 ms integration time, without any filter to collect all wavelengths. Emitted relative light units (URL) were corrected by basal luminescence of HeLa_hOX40_NFκB_Luc1 cells and were blotted against the logarithmic primary antibody concentration using Prism4 (GraphPad Software, USA). Curves were fitted using the inbuilt sigmoidal dose response.

Figure 7A:
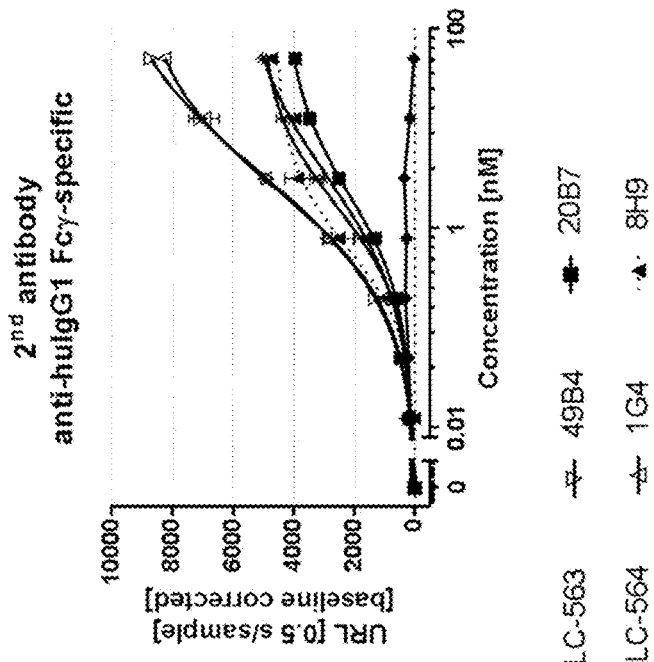
FIGS. 7A and 7B show the effect of the anti-human OX40 antibodies of the invention on HeLa cells expressing human OX40 and reporter gene NF-κB-luciferase. Shown is the activation of NF-κB signaling pathway in the reporter cell line with various anti-OX40 binders in a P329GLALA huIgG1 format with (FIG. 7B) or without (FIG. 7B) cross-linking by secondary-antibody. The reporter cells were cultured for 6 hours in the presence of anti-OX40 constructs at the indicated concentrations w/ or w/o crosslinking secondary poly-clonal anti-huIgG1 Fcγ-specific goat IgG F(ab)2 fragment in a 1:2 ratio. Activity is characterized by blotting the units of released light (URL) measured during 0.5 s versus the concentration in nM of tested anti-Ox40 construct. URLs are emitted due to luciferase-mediated oxidation of luciferin to oxyluciferin. All clones are able to induce NFκB activation when the OX40 axis is triggered in a human OX40+ reporter cell line. All clones are thus agonistic and activate in a dose dependent way. Crosslinking by secondary Fc part specific Abs strongly increases this agonism.
Figure 7B:
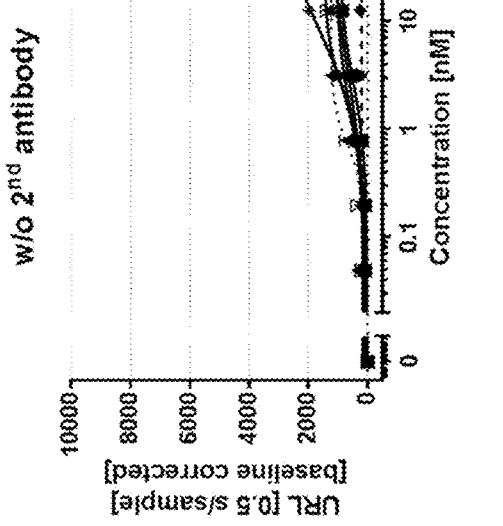

As shown in FIGS. 7A and 7B, a limited, dose dependent NFκB activation was induced already by addition of anti-OX40 P329GLALA huIgG1 antibodies (left side) to the reporter cell line. Hyper-crosslinking of anti-OX40 antibodies by anti-human IgG specific secondary antibodies strongly increased the induction of NFκB-mediated luciferase-activation in a concentration-dependent manner (right side). The $EC_{50}$ values of activation are summarized in Table 23.

TABLE 23

$EC_{50}$ values of NFκB activation in the HeLa_hOx40_NFκB_luc1 reporter cell line co-incubated with anti-Ox40 binders (huIgG1 P329GLALA format) and secondary anti-human IgG Fcγ spec. antibodies

| Clone | $EC_{50}$ [nM] |
|---|---|
| 8H9 | 0.66 |
| CLC563 | 1.69 |
| 20B7 | 2.27 |
| 49B4 | 2.42 |
| CLC-564 | 3.23 |
| 1G4 | 3.59 |

3.2 OX40 Mediated Costimulation of Suboptimally TCR Triggered Pre-activated Human CD4 T Cells Ligation of OX40 provides a synergistic co-stimulatory signal promoting division and survival of T-cells following suboptimal T-cell receptor (TCR) stimulation (M. Croft et al., Immunol. Rev. 2009, 229(1), 173-191). Additionally, production of several cytokines and surface expression of T-cell activation markers is increased (I. Gramaglia et al., J. Immunol. 1998, 161(12), 6510-6517; S. M. Jensen et al., Seminars in Oncology 2010, 37(5), 524-532).

To test agonistic properties of various anti-OX40 binders, pre-activated Ox40 positive CD4 T-cells were stimulated for 72 hours with a suboptimal concentration of plate-immobilized anti-CD3 antibodies in the presence of anti-OX40 antibodies, either in solution or immobilized on the plate surface. Effects on T-cell survival and proliferation were analyzed through monitoring of total cell counts and CFSE dilution in living cells by flow cytometry. Additionally, cells were co-stained with fluorescently-labeled antibodies against T-cell activation and differentiation markers, e.g. CD127, CD45RA, Tim-3, CD62L and OX40 itself.

Human PBMCs were isolated via ficoll density centrifugation and were simulated for three days with PHA-L [2 μg/mL] and Proleukin [200 U/mL] as described under Example 2.1.2. Cells were then labeled with CFSE at a cell density of $1 \times 10^6$ cells/mL with CFDA-SE (Sigma-Aldrich, Cat.-No. 2188) at a final concentration of [50 nM] for 10 minutes at 37° C. Thereafter, cells were washed twice with excess DPBS containing FBS (10% v/v). Labeled cells were rested in T-cell media at 37° C. for 30 minutes. Thereafter, non-converted CFDA-SE was removed by two additional washing steps with DPBS. CD4 T-cell isolation from pre-activated CFSE-labeled human PBMC was performed using the MACS negative CD4 T-cell isolation kit (Miltenyi Biotec,) according to manufacturer instructions.

Morris et al. showed that agonistic co-stimulation with conventional anti-Ox40 antibodies relied on surface immobilization (N. P. Morris et al., Mol. Immunol. 2007, 44(12), 3112-3121). Thus, goat anti-mouse Fcγ-specific antibodies (Jackson ImmunoResearch, Cat.No. 111-500-5008) were coated to the surface of a 96 well U-bottom cell culture plate (Greiner Bio One) at a concentration of [2 µg/mL] in PBS over night at 4° C. in the presence (surface immobilized anti-OX40) or absence (anti-OX40 in solution) of goat anti-human Fcγ-specific antibody (Jackson ImmunoResearch, Ca.No. 109-006-098). Thereafter, the plate surface was blocked with DPBS containing BSA (1% v/w). All T cell following incubation steps were done at 37° C. for 90 minutes in PBS containing BSA (1% v/w). Between the incubation steps, plates were washed with DPBS.

Mouse anti-human CD3 antibody (clone OKT3, eBioscience, Ca.No. 16-0037-85, fixed concentration [3 ng/mL]) was captured in a subsequent incubation step via the surface coated anti-mouse Fcγ-specific antibodies. In one experiment titrated human anti-OX40 antibodies (human $IgG_1$ P329G LALA) were then immobilized on plate by an additional incubation step in DPBS. In a second experiment anti-OX40 antibodies were added during the activation assay directly to the media to plates not pre-coated with anti-human IgG Fc specific antibodies.

CFSE-labeled preactivated CD4+ T cells were added to the pre-coated plates at a cell density of $0.6*10^5$ cells per well in 200 µL T-cell media and cultured for 96 hours. Cells were stained with a combination of fluorochrome-labeled mouse anti-human Ox40 (clone BerACT35, Bioledgend, Ca.No. 35008), TIM-3 (clone F38-2E2, Biolegend, Ca.No. 345008), CD127 (clone A019D5, Biolegend, Ca.No. 351234), CD62L (clone DREG 56, Biolegend, Ca.No. 304834) and CD45RA (clone HI100, BD Biosciences, Ca.No. 555489) for 20 minutes at 4° C. in the dark. Plates where washed twice with 200 µL/well 4° C. FACS buffer, were finally resuspended in 80 µL/well FACS-buffer containing 0.2 µg/mL DAPI (Santa Cruz Biotec, Cat. No. Sc-3598) and acquired the same day using 5-laser LSR-Fortessa (BD Bioscience with DIVA software).

DAPI negative living cells were analyzed for decrease in median CFSE fluorescence as a marker for proliferation. The percentage of OX40 positive, CD62L low and TIM-3 positive T cells was monitored as a marker for T-cell activation. The expression of CD45RA and CD127 was analyzed to determine changes in maturation status of T cell, whereby CD45RA low CD127 low cells were categorized as effector T cells.

Figure 9:
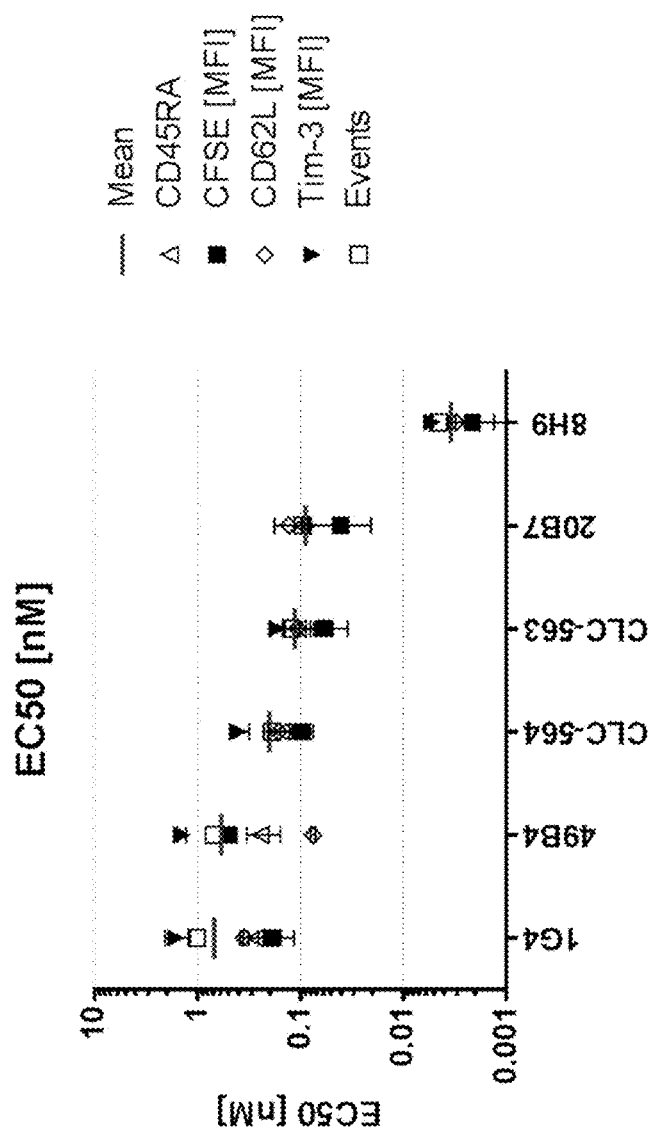
FIG. 9 summarizes the $EC_{50}$ values (for all biomarkers) as marker for the agonistic capacity of the respective clone (values calculated from the curves shown in FIG. 8). The potency increases from left to right. The event count, the percentage of proliferating (CFSE-low) cells and the percentage of CD62L low, CD45RA low or Tim-3 positive cells at day 4 were plotted vs the anti-Ox40 antibody concentration and $EC_{50}$ values were calculated using the inbuilt sigmoidal dose response quotation in Prism4 (GraphPad Software, USA).

Co-stimulation with plate-immobilized antibodies strongly enhanced suboptimal stimulation of pre-activated human CD4 T cells with plate-immobilized anti-human CD3 in a dose dependent manner (FIGS. 8A-8F). T-cells proliferated stronger, showed a more mature phenotype with a higher percentage of effector T cells and had higher percentages of CD62L low, Tim-3 positive and OX40 positive activated cells. Some clones (8H9, 20B7) out-competed the commercially available detection antibody in binding to cellular OX40. For those no $EC_{50}$ value calculation was possible and thus all $EC_{50}$ values for OX40 induction were excluded from overall $EC_{50}$ value calculation. Half-maximal changes in all other parameters of T-cell activation were achieved at concentrations ranging from 3 to 700 pM and are summarized in FIG. 9 and Table 24. No enhancement in suboptimal TCR stimulation was seen when anti-Ox40 antibodies were added in solution in the absence of surface immobilization (FIGS. 10A-10F). This demonstrated again the strong dependency of Ox40 axis activation on hyper-crosslinking of the OX40 receptor.

Figure 11:
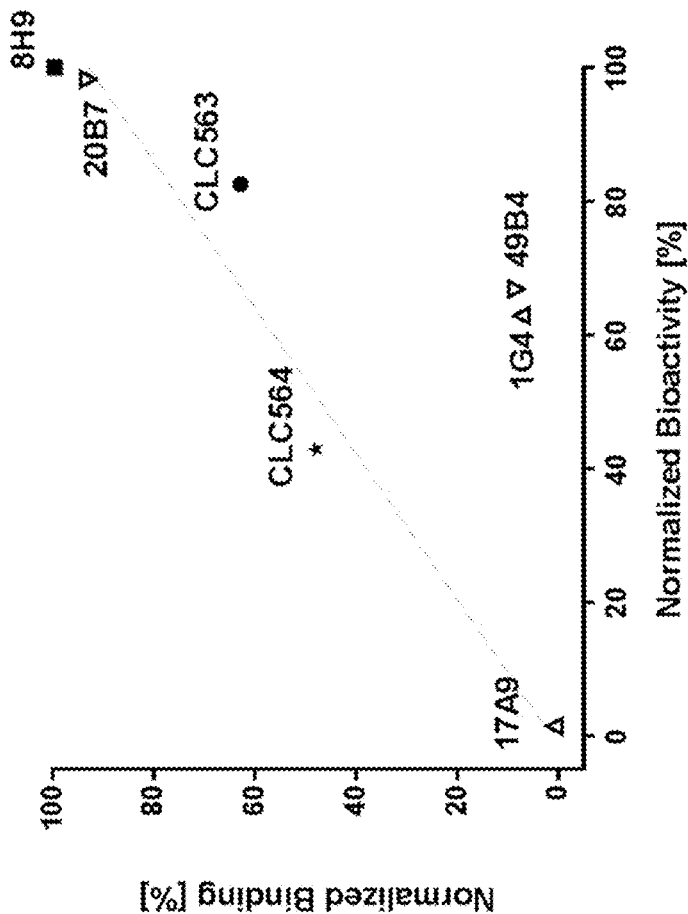
FIG. 11 shows a correlation between the binding strength and agonistic capacity of the different anti-OX40 clones. Binding of anti-Ox40 clones (huIgG1 P329GLALA format) on activated CD4 T cells was performed as described in Example 2.1.2. Plateau values were normalized to the value obtained with clone 8H9 (huIgG1 P329GLALA format). Bioactivity testing of anti-Ox40 clones (huIgG1 P329GLALA format) was performed as described in Example 3.2 and plateau values of PD-1 expression were normalized to the values obtained for clone 8H9 (huIgG1 P329GLALA format). Normalized binding was plotted against normalized bioactivity, to test for a correlation between binding strength and agonistic capacity. For most clones there was a direct correlation (linear regression is shown, p value 0.96; slope 0.91). However, two clones (49B4, 1G4) showed a much stronger bioactivity then could be predicted from their binding strength. This subgroup of clones which show unexpectedly high agonistic potency in the face of low binding ability is of particular interest for the bispecific antigen binding molecules of the invention.

A correlation between the binding strength and the agonistic activity (bioactivity) of the anti-OX40 antibodies (hu IgG1 P329GLALA format) is shown in FIG. 11. For most clones there was a direct correlation, however surprisingly two clones (49B4, 1G4) showed a much stronger bioactivity then was predicted from their binding strength.

TABLE 24

$EC_{50}$ values of of rescuing suboptimal TCR stimulation with plate-immobilized anti-OX40 binders (huIgG1 P329GLALA format)

| Clone | $EC_{50}$ [nM] | SEM (+/−) |
|---|---|---|
| 8H9 | 0.003 | 0.001 |
| 20B7 | 0.090 | 0.015 |
| CLC-563 | 0.114 | 0.018 |
| CLC-564 | 0.202 | 0.053 |
| 49B4 | 0.591 | 0.237 |
| 1G4 | 0.697 | 0.278 |

Example 4

Generation of Bispecific Constructs Targeting Ox40 and Fibroblast Activation Protein (FAP)

4.1 Generation of Bispecific Bivalent Antigen Binding Molecules Targeting Ox40 and Fibroblast Activation Protein (FAP) (2+2 Format)

Bispecific agonistic Ox40 antibodies with bivalent binding for Ox40 and for FAP were prepared. The crossmab technology in accordance with International patent application No. WO 2010/145792 A1 was applied to reduce the formation of wrongly paired light chains.

The generation and preparation of the FAP binders is described in WO 2012/020006 A2, which is incorporated herein by reference.

In this example, a crossed Fab unit (VHCL) of the FAP binder 28H1 was C-terminally fused to the heavy chain of an anti-OX40 huIgG1 using a (G4S)$_4$ connector sequence. This heavy chain fusion was co-expressed with the light chain of the anti-OX40 and the corresponding FAP crossed light chain (VLCH1). The Pro329Gly, Leu234Ala and Leu235Ala mutations have been introduced in the constant region of the heavy chains to abrogate binding to Fc gamma receptors according to the method described in International Patent Appl. Publ. No. WO 2012/130831 A1. The resulting bispecific, bivalent construct is depicted in FIG. 12A.

Table 25 shows, respectively, the nucleotide and amino acid sequences of mature bispecific, bivalent anti-OX40/anti-FAP human IgG1 P329GLALA antibodies.

TABLE 25

Sequences of bispecific, bivalent anti-OX40/anti-FAP human IgG1 P329GLALA antigen binding molecules

| SEQ ID NO: | Description | Sequence |
|---|---|---|
| 214 | (8B9) VHCH1-Heavy chain-(28H1) VHCL (nucleotide sequence) | CAGGTGCAATTGGTGCAGTCTGGGGCTGAGGTGAAGAAG CCTGGGTCCTCGGTGAAGGTCTCCTGCAAGGCCTCCGGAG GCACATTCAGCAGCTACGCTATAAGCTGGGTGCGACAGG CCCCTGGACAAGGGCTCGAGTGGATGGGAGGGATCATCC CTATCTTTGGTACAGCAAACTACGCACAGAAGTTCCAGGG CAGGGTCACCATTACTGCAGACAAATCCACGAGCACAGC CTACATGGAGCTGAGCAGCCTGAGATCTGAGGACACCGC CGTGTATTACTGTGCGAGAGAATACGGTTGGATGGACTAC TGGGGCCAAGGGACCACCGTGACCGTCTCCTCAGCTAGC ACCAAGGGCCCATCCGTGTTCCCTCTGGCCCCTTCCAGCA AGTCTACCTCTGGCGGCACAGCCGCTCTGGGCTGCCTCGT GAAGGACTACTTCCCCGAGCCTGTGACAGTGTCCTGGAAC TCTGGCGCCCTGACATCCGGCGTGCACACCTTTCCAGCTG TGCTGCAGTCCTCCGGCCTGTACTCCCTGTCCTCCGTCGTG ACAGTGCCCTCCAGCTCTCTGGGCACCCAGACCTACATCT GCAACGTGAACCACAAGCCCTCCAACACCAAGGTGGACA AGAAGGTGGAACCCAAGTCCTGCGACAAGACCCACACCT GTCCCCCTTGTCCTGCCCCTGAAGCTGCTGGCGGCCCTAG CGTGTTCCTGTTCCCCCCAAAGCCCAAGGACACCCTGATG ATCTCCCGGACCCCCGAAGTGACCTGCGTGGTGGTGGATG TGTCCCACGAGGACCCTGAAGTGAAGTTCAATTGGTACGT GGACGGCGTGGAAGTGCACAATGCCAAGACCAAGCCTAG AGAGGAACAGTACAACTCCACCTACCGGGTGGTGTCCGT GCTGACCGTGCTGCACCAGGATTGGCTGAACGGCAAAGA GTACAAGTGCAAGGTGTCCAACAAGGGCCCTGGGAGCCCC CATCGAAAAGACCATCTCCAAGGCCAAGGGCCAGCCTCG CGAGCCTCAGGTGTACACCCTGCCCCCTAGCAGAGATGA GCTGACCAAGAACCAGGTGTCCCTGACCTGTCTCGTGAAA GGCTTCTACCCCTCCGATATCGCCGTGGAATGGGAGAGCA ACGGCCAGCCCGAGAACAACTACAAGACCACCCCCCCTG TGCTGGACTCCGACGGCTCATTCTTCCTGTACTCTAAGCT GACAGTGGACAAGTCCCGGTGGCAGCAGGGCAACGTGTT CTCCTGCTCCGTGATGCACGAGGCCCTGCACAACCACTAC ACCCAGAAGTCCCTGTCCCTGTCTCCCGGGGGAGGCGGA GGATCTGGCGGAGGCGGATCCGGTGGTGGCGGATCTGGG GGCGGTGGATCTGAGGTGCAGCTGCTGGAATCTGGGGGA GGACTGGTGCAGCCAGGCGGATCTCTGAGGCTGTCCTGC GCTGCTTCCGGCTTTACCTTCTCCAGCCACGCCATGAGTT GGGTGCGCCAGGCACCCGGAAAAGGACTGGAATGGGTGT CAGCCATCTGGGCCTCCGGCGAGCAGTACTACGCCGATA GCGTGAAGGGCCGGTTCACCATCTCTCGGGATAACAGCA AGAATACTCTGTACCTGCAGATGAACTCCCTGCGCGCTGA AGATACCGCTGTGTATTACTGCGCCAAGGGCTGGCTGGGC AACTTCGATTACTGGGGCCAGGGAACCCTCGTGACTGTCT CGAGCGCTTCTGTGGCCGCTCCCTCCGTGTTCATCTTCCCA CCTTCCGACGAGCAGCTGAAGTCCGGCACTGCCTCTGTCG TGTGCCTGCTGAACAACTTCTACCCTCGGGAAGCCAAGGT GCAGTGGAAAGTGGATAACGCCCTGCAGTCCGGCAACTC CCAGGAATCCGTGACCGAGCAGGACTCCAAGGACAGCAC CTACTCCCTGAGCAGCACCCTGACCCTGTCCAAGGCCGAC TACGAGAAGCACAAGGTGTACGCCTGTGAAGTGACCCAC CAGGGCCTGTCCAGCCCCGTGACCAAGTCCTTCAACCGGG GCGAGTGC |
| 180 | VLCL-Light chain 1 (8B9) (nucleotide sequence) | see Table 13 |
| 215 | VLCH1-Light chain 2 (28H1) (nucleotide sequence) | GAGATCGTGCTGACCCAGTCTCCCGGCACCCTGAGCCTGA GCCCTGGCGAGAGAGCCACCCTGAGCTGCAGGGCCAGCC AGAGCGTGAGCCGGAGCTACCTGGCCTGGTATCAGCAGA AGCCCGGCCAGGCCCCCAGACTGCTGATCATCGGCGCCA GCACCCGGGCCACCGGCATCCCCGATAGATTCAGCGGCA GCGGCTCCGGCACCGACTTCACCCTGACCATCAGCCGGCT GGAACCCGAGGACTTCGCCGTGTACTACTGCCAGCAGGG CCAGGTGATCCCCCCCACCTTCGGCCAGGGCACCAAGGT GGAAATCAAGAGCTCCGCTAGCACCAAGGGCCCCTCCGT GTTTCCTCTGGCCCCCAGCAGCAAGAGCACCTCTGGCGGA ACAGCCGCCCTGGGCTGCCTGGTGAAAGACTACTTCCCCG AGCCCGTGACCGTGTCCTGGAACTCTGGCGCCCTGACCAG CGGCGTGCACACCTTTCCAGCCGTGCTGCAGAGCAGCGG CCTGTACTCCCTGAGCAGCGTGGTGACAGTGCCCTCCAGC AGCCTGGGCACCCAGACCTACATCTGCAACGTGAACCAC |

TABLE 25-continued

Sequences of bispecific, bivalent anti-OX40/anti-FAP human
IgG1 P329GLALA antigen binding molecules

| SEQ ID NO: | Description | Sequence |
|---|---|---|
| | | AAGCCCAGCAACACCAAAGTGGACAAGAAGGTGGAACCC AAGAGCTGCGAC |
| 216 | (8B9) VHCH1-Heavy chain-(28H1) VHCL | QVQLVQSGAEVKKPGSSVKVSCKASGGTFSSYAISWVRQAP GQGLEWMGGIIPIFGTANYAQKFQGRVTITADKSTSTAYME LSSLRSEDTAVYYCAREYGWMDYWGQGTTVTVSSASTKGP SVFPLAPSSKSTSGGTAALGCLVKDYFPEPVTVSWNSGALTS GVHTFPAVLQSSGLYSLSSVVTVPSSSLGTQTYICNVNHKPS NTKVDKKVEPKSCDKTHTCPPCPAPEAAGGPSVFLFPPKPKD TLMISRTPEVTCVVVDVSHEDPEVKFNWYVDGVEVHNAKT KPREEQYNSTYRVVSVLTVLHQDWLNGKEYKCKVSNKALG APIEKTISKAKGQPREPQVYTLPPSRDELTKNQVSLTCLVKG FYPSDIAVEWESNGQPENNYKTTPPVLDSDGSFFLYSKLTVD KSRWQQGNVFSCSVMHEALHNHYTQKSLSLSPGGGGGSGG GGSGGGGSGGGGSEVQLLESGGGLVQPGGSLRLSCAASGFT FSSHAMSWVRQAPGKGLEWVSAIWASGEQYYADSVKGRFT ISRDNSKNTLYLQMNSLRAEDTAVYYCAKGWLGNFDYWG QGTLVTVSSASVAAPSVFIFPPSDEQLKSGTASVVCLLNNFY PREAKVQWKVDNALQSGNSQESVTEQDSKDSTYSLSSTLTL SKADYEKHKVYACEVTHQGLSSPVTKSFNRGEC |
| 182 | VLCL-Light chain 1 (8B9) | see Table 13 |
| 217 | VLCH1-Light chain 2 (28H1) | EIVLTQSPGTLSLSPGERATLSCRASQSVSRSYLAWYQQKPG QAPRLLIIGASTRATGIPDRFSGSGSGTDFTLTISRLEPEDFAV YYCQQGQVIPPTFGQGTKVEIKSSASTKGPSVFPLAPSSKSTS GGTAALGCLVKDYFPEPVTVSWNSGALTSGVHTFPAVLQSS GLYSLSSVVTVPSSSLGTQTYICNVNHKPSNTKVDKKVEPKS CD |
| 218 | (49B4) VHCH1-Heavy chain-(28H1) VHCL (nucleotide sequence) | CAGGTGCAATTGGTGCAGTCTGGGGCTGAGGTGAAGAAG CCTGGGTCCTCGGTGAAGGTCTCCTGCAAGGCCTCCGGAG GCACATTCAGCAGCTACGCTATAAGCTGGGTGCGACAGG CCCCTGGACAAGGGCTCGAGTGGATGGGAGGGATCATCC CTATCTTTGGTACAGCAAACTACGCACAGAAGTTCCAGGG CAGGGTCACCATTACTGCAGACAAATCCACGAGCACAGC CTACATGGAGCTGAGCAGCCTGAGATCTGAGGACACCGC CGTGTATTACTGTGCGAGAGAATACTACCGTGGTCCGTAC GACTACTGGGGCCAAGGGACCACCGTGACCGTCTCCTCA GCTAGCACCAAGGGCCCATCCGTGTTCCCTCTGGCCCCTT CCAGCAAGTCTACCTCTGGCGGCACAGCCGCTCTGGGCTG CCTCGTGAAGGACTACTTCCCCGAGCCTGTGACAGTGTCC TGGAACTCTGGCGCCCTGACATCCGGCGTGCACACCTTTC CAGCTGTGCTGCAGTCCTCCGGCCTGTACTCCCTGTCCTC CGTCGTGACAGTGCCCTCCAGCTCTCTGGGCACCCAGACC TACATCTGCAACGTGAACCACAAGCCCTCCAACACCAAG GTGGACAAGAAGGTGGAACCCAAGTCCTGCGACAAGACC CACACCTGTCCCCCTTGTCCTGCCCCTGAAGCTGCTGGCG GCCCTAGCGTGTTCCTGTTCCCCCCAAAGCCCAAGGACAC CCTGATGATCTCCCGGACCCCCGAAGTGACCTGCGTGGTG GTGGATGTGTCCCACGAGGACCCTGAAGTGAAGTTCAATT GGTACGTGGACGGCGTGGAAGTGCACAATGCCAAGACCA AGCCTAGAGAGGAACAGTACAACTCCACCTACCGGGTGG TGTCCGTGCTGACCGTGCTGCACCAGGATTGGCTGAACGG CAAAGAGTACAAGTGCAAGGTGTCCAACAAGGCCCTGGG AGCCCCCATCGAAAAGACCATCTCCAAGGCCAAGGGCCA GCCTCGCGAGCCTCAGGTGTACACCCTGCCCCCTAGCAGA GATGAGCTGACCAAGAACCAGGTGTCCCTGACCTGTCTCG TGAAAGGCTTCTACCCCTCCGATATCGCCGTGGAATGGGA GAGCAACGGCCAGCCCGAGAACAACTACAAGACCACCCC CCCTGTGCTGGACTCCGACGGCTCATTCTTCCTGTACTCTA AGCTGACAGTGGACAAGTCCCGGTGGCAGCAGGGCAACG TGTTCTCCTGCTCCGTGATGCACGAGGCCCTGCACAACCA CTACACCCAGAAGTCCCTGTCCCTGTCTCCGGGGAGGC GGAGGATCTGGCGGAGGCGGATCCGGTGGTGGCGGATCT GGGGGCGGTGGATCTGAGGTGCAGCTGCTGGAATCTGGG GGAGGACTGGTGCAGCCAGGCGGATCTCTGAGGCTGTCC TGCGCTGCTTCCGGCTTTACCTTCTCCAGCCACGCCATGA GTTGGGTGCGCCAGGCACCCGGAAAAGGACTGGAATGGG TGTCAGCCATCTGGGCCTCCGGCGAGCAGTACTACGCCGA TAGCGTGAAGGGCCGGTTCACCATCTCTCGGGATAACAG CAAGAATACTCTGTACCTGCAGATGAACTCCCTGCGCGCT GAAGATACCGCTGTGTATTACTGCGCCAAGGGCTGGCTG |

TABLE 25-continued

Sequences of bispecific, bivalent anti-OX40/anti-FAP human IgG1 P329GLALA antigen binding molecules

| SEQ ID NO: | Description | Sequence |
|---|---|---|
| | | GGCAACTTCGATTACTGGGGCCAGGGAACCCTCGTGACT GTCTCGAGCGCTTCTGTGGCCGCTCCCTCCGTGTTCATCTT CCCACCTTCCGACGAGCAGCTGAAGTCCGGCACTGCCTCT GTCGTGTGCCTGCTGAACAACTTCTACCCTCGGGAAGCCA AGGTGCAGTGGAAAGTGGATAACGCCCTGCAGTCCGGCA ACTCCCAGGAATCCGTGACCGAGCAGGACTCCAAGGACA GCACCTACTCCCTGAGCAGCACCCTGACCCTGTCCAAGGC CGACTACGAGAAGCACAAGGTGTACGCCTGTGAAGTGAC CCACCAGGGCCTGTCCAGCCCCGTGACCAAGTCCTTCAAC CGGGGCGAGTGC |
| 184 | VLCL-Light chain 1 (49B4) (nucleotide sequence) | see Table 13 |
| 215 | VLCH1-Light chain 2 (28H1) (nucleotide sequence) | see above |
| 219 | (49B4) VHCH1-Heavy chain-(28H1) VHCL | QVQLVQSGAEVKKPGSSVKVSCKASGGTFSSYAISWVRQAP GQGLEWMGGIIPIFGTANYAQKFQGRVTITADKSTSTAYME LSSLRSEDTAVYYCAREYYRGPYDYWGQGTTVTVSSASTK GPSVFPLAPSSKSTSGGTAALGCLVKDYFPEPVTVSWNSGAL TSGVHTFPAVLQSSGLYSLSSVVTVPSSSLGTQTYICNVNHK PSNTKVDKKVEPKSCDKTHTCPPCPAPEAAGGPSVFLFPPKP KDTLMISRTPEVTCVVVDVSHEDPEVKFNWYVDGVEVHNA KTKPREEQYNSTYRVVSVLTVLHQDWLNGKEYKCKVSNKA LGAPIEKTISKAKGQPREPQVYTLPPSRDELTKNQVSLTCLV KGFYPSDIAVEWESNGQPENNYKTTPPVLDSDGSFFLYSKLT VDKSRWQQGNVFSCSVMHEALHNHYTQKSLSLSPGGGGGS GGGGSGGGGSGGGGSEVQLLESGGGLVQPGGSLRLSCAAS GFTFSSHAMSWVRQAPGKGLEWVSAIWASGEQYYADSVKG RFTISRDNSKNTLYLQMNSLRAEDTAVYYCAKGWLGNFDY WGQGTLVTVSSASVAAPSVFIFPPSDEQLKSGTASVVCLLNN FYPREAKVQWKVDNALQSGNSQESVTEQDSKDSTYSLSSTL TLSKADYEKHKVYACEVTHQGLSSPVTKSFNRGEC |
| 186 | VLCL-Light chain 1 (49B4) | see Table 13 |
| 217 | VLCH1-Light chain 2 (28H1) | see above |
| 220 | (1G4) VHCH1-Heavy chain-(28H1) VHCL (nucleotide sequence) | CAGGTGCAATTGGTGCAGTCTGGGGCTGAGGTGAAGAAG CCTGGGTCCTCGGTGAAGGTCTCCTGCAAGGCCTCCGGAG GCACATTCAGCAGCTACGCTATAAGCTGGGTGCGACAGG CCCCTGGACAAGGGCTCGAGTGGATGGGAGGGATCATCC CTATCTTTGGTACAGCAAACTACGCACAGAAGTTCCAGGG CAGGGTCACCATTACTGCAGACAAATCCACGAGCACAGC CTACATGGAGCTGAGCAGCCTGAGATCTGAGGACACCGC CGTGTATTACTGTGCGAGAGAATACGGTTCTATGGACTAC TGGGGCCAAGGGACCACCGTGACCGTCTCCTCAGCTAGC ACCAAGGGCCCATCCGTGTTCCCTCTGGCCCCTTCCAGCA AGTCTACCTCTGGCGGCACAGCCGCTCTGGGCTGCCTCGT GAAGGACTACTTCCCCGAGCCTGTGACAGTGTCCTGGAAC TCTGGCGCCCTGACATCCGGCGTGCACACCTTTCCAGCTG TGCTGCAGTCCTCCGGCCTGTACTCCCTGTCCTCCGTCGTG ACAGTGCCCTCCAGCTCTCTGGGCACCCAGACCTACATCT GCAACGTGAACCACAAGCCCTCCAACACCAAGGTGGACA AGAAGGTGGAACCCAAGTCCTGCGACAAGACCCACACCT GTCCCCCTTGTCCTGCCCCTGAAGCTGCTGGCGGCCCTAG CGTGTTCCTGTTCCCCCCAAAGCCCAAGGACACCCTGATG ATCTCCCGGACCCCCGAAGTGACCTGCGTGGTGGTGGATG TGTCCCACGAGGACCCTGAAGTGAAGTTCAATTGGTACGT GGACGGCGTGGAAGTGCACAATGCCAAGACCAAGCCTAG AGAGGAACAGTACAACTCCACCTACCGGGTGGTGTCCGT GCTGACCGTGCTGCACCAGGATTGGCTGAACGGCAAAGA GTACAAGTGCAAGGTGTCCAACAAGGCCCTGGGAGCCCC CATCGAAAAGACCATCTCCAAGGCCAAGGGCCAGCCTCG CGAGCCTCAGGTGTACACCCTGCCCCCTAGCAGAGATGA GCTGACCAAGAACCAGGTGTCCCTGACCTGTCTCGTGAAA GGCTTCTACCCCTCCGATATCGCCGTGGAATGGGAGAGCA |

TABLE 25-continued

Sequences of bispecific, bivalent anti-OX40/anti-FAP human
IgG1 P329GLALA antigen binding molecules

| SEQ ID NO: | Description | Sequence |
|---|---|---|
| | | ACGGCCAGCCCGAGAACAACTACAAGACCACCCCCCCTG<br>TGCTGGACTCCGACGGCTCATTCTTCCTGTACTCTAAGCT<br>GACAGTGGACAAGTCCCGGTGGCAGCAGGGCAACGTGTT<br>CTCCTGCTCCGTGATGCACGAGGCCCTGCACAACCACTAC<br>ACCCAGAAGTCCCTGTCCCTGTCTCCCGGGGAGGCGGA<br>GGATCTGGCGGAGGCGGATCCGGTGGTGGCGGATCTGGG<br>GGCGGTGGATCTGAGGTGCAGCTGCTGGAATCTGGGGGA<br>GGACTGGTGCAGCCAGGCGGATCTCTGAGGCTGTCCTGC<br>GCTGCTTCCGGCTTTACCTTCTCCAGCCACGCCATGAGTT<br>GGGTGCGCCAGGCACCCGGAAAAGGACTGGAATGGGTGT<br>CAGCCATCTGGGCCTCCGGCGAGCAGTACTACGCCGATA<br>GCGTGAAGGGCCGGTTCACCATCTCTCGGGATAACAGCA<br>AGAATACTCTGTACCTGCAGATGAACTCCCTGCGCGCTGA<br>AGATACCGCTGTGTATTACTGCGCCAAGGGCTGGCTGGGC<br>AACTTCGATTACTGGGGCCAGGGAACCCTCGTGACTGTCT<br>CGAGCGCTTCTGTGGCCGCTCCCTCCGTGTTCATCTTCCCA<br>CCTTCCGACGAGCAGCTGAAGTCCGGCACTGCCTCTGTCG<br>TGTGCCTGCTGAACAACTTCTACCCTCGGGAAGCCAAGGT<br>GCAGTGGAAAGTGGATAACGCCCTGCAGTCCGGCAACTC<br>CCAGGAATCCGTGACCGAGCAGGACTCCAAGGACAGCAC<br>CTACTCCCTGAGCAGCACCCTGACCCTGTCCAAGGCCGAC<br>TACGAGAAGCACAAGGTGTACGCCTGTGAAGTGACCCAC<br>CAGGGCCTGTCCAGCCCCGTGACCAAGTCCTTCAACCGGG<br>GCGAGTGC |
| 188 | VLCL-Light chain 1 (1G4) (nucleotide sequence) | see Table 13 |
| 215 | VLCH1-Light chain 2 (28H1) (nucleotide sequence) | see above |
| 221 | (1G4) VHCH1- Heavy chain- (28H1) VHCL | QVQLVQSGAEVKKPGSSVKVSCKASGGTFSSYAISWVRQAP<br>GQGLEWMGGIIPIFGTANYAQKFQGRVTITADKSTSTAYME<br>LSSLRSEDTAVYYCAREYGSMDYWGQGTTVTVSSASTKGPS<br>VFPLAPSSKSTSGGTAALGCLVKDYFPEPVTVSWNSGALTSG<br>VHTFPAVLQSSGLYSLSSVVTVPSSSLGTQTYICNVNHKPSN<br>TKVDKKVEPKSCDKTHTCPPCPAPEAAGGPSVFLFPPKPKDT<br>LMISRTPEVTCVVVDVSHEDPEVKFNWYVDGVEVHNAKTK<br>PREEQYNSTYRVVSVLTVLHQDWLNGKEYKCKVSNKALGA<br>PIEKTISKAKGQPREPQVYTLPPSRDELTKNQVSLTCLVKGF<br>YPSDIAVEWESNGQPENNYKTTPPVLDSDGSFFLYSKLTVDK<br>SRWQQGNVFSCSVMHEALHNHYTQKSLSLSPGGGGGSGGG<br>GSGGGGSGGGGSEVQLLESGGGLVQPGGSLRLSCAASGFTF<br>SSHAMSWVRQAPGKGLEWVSAIWASGEQYYADSVKGRFTI<br>SRDNSKNTLYLQMNSLRAEDTAVYYCAKGWLGNFDYWGQ<br>GTLVTVSSASVAAPSVFIFPPSDEQLKSGTASVVCLLNNFYPR<br>EAKVQWKVDNALQSGNSQESVTEQDSKDSTYSLSSTLTLSK<br>ADYEKHKVYACEVTHQGLSSPVTKSFNRGEC |
| 190 | VLCL-Light chain 1 (1G4) | see Table 13 |
| 217 | VLCH1-Light chain 2 (28H1) | see above |
| 222 | (20B7) VHCH1- Heavy chain- (28H1) VHCL (nucleotide sequence) | CAGGTGCAATTGGTGCAGTCTGGGGCTGAGGTGAAGAAG<br>CCTGGGTCCTCGGTGAAGGTCTCCTGCAAGGCCTCCGGAG<br>GCACATTCAGCAGCTACGCTATAAGCTGGGTGCGACAGG<br>CCCCTGGACAAGGGCTCGAGTGGATGGGAGGGATCATCC<br>CTATCTTTGGTACAGCAAACTACGCACAGAAGTTCCAGGG<br>CAGGGTCACCATTACTGCAGACAAATCCACGAGCACAGC<br>CTACATGGAGCTGAGCAGCCTGAGATCTGAGGACACCGC<br>CGTGTATTACTGTGCGAGAGTTAACTACCCGTACTCTTAC<br>TGGGGTGACTTCGACTACTGGGGCCAAGGGACCACCGTG<br>ACCGTCTCCTCAGCTAGCACCAAGGGCCCATCCGTGTTCC<br>CTCTGGCCCCTTCCAGCAAGTCTACCTCTGGCGGCACAGC<br>CGCTCTGGGCTGCCTCGTGAAGGACTACTTCCCCGAGCCT<br>GTGACAGTGTCCTGGAACTCTGGCGCCCTGACATCCGGCG<br>TGCACACCTTTCCAGCTGTGCTGCAGTCCTCCGGCCTGTA<br>CTCCCTGTCCTCCGTCGTGACAGTGCCCTCCAGCTCTCTG |

TABLE 25-continued

Sequences of bispecific, bivalent anti-OX40/anti-FAP human
IgG1 P329GLALA antigen binding molecules

| SEQ ID NO: | Description | Sequence |
|---|---|---|
| | | GGCACCCAGACCTACATCTGCAACGTGAACCACAAGCCC<br>TCCAACACCAAGGTGGACAAGAAGGTGGAACCCAAGTCC<br>TGCGACAAGACCCACACCTGTCCCCCTTGTCCTGCCCCTG<br>AAGCTGCTGGCGGCCCTAGCGTGTTCCTGTTCCCCCCAAA<br>GCCCAAGGACACCCTGATGATCTCCCGGACCCCCGAAGT<br>GACCTGCGTGGTGGTGGATGTGTCCCACGAGGACCCTGA<br>AGTGAAGTTCAATTGGTACGTGGACGGCGTGGAAGTGCA<br>CAATGCCAAGACCAAGCCTAGAGAGGAACAGTACAACTC<br>CACCTACCGGGTGGTGTCCGTGCTGACCGTGCTGCACCAG<br>GATTGGCTGAACGGCAAAGAGTACAAGTGCAAGGTGTCC<br>AACAAGGCCCTGGGAGCCCCCATCGAAAAGACCATCTCC<br>AAGGCCAAGGGCCAGCCTCGCGAGCCTCAGGTGTACACC<br>CTGCCCCCTAGCAGAGATGAGCTGACCAAGAACCAGGTG<br>TCCCTGACCTGTCTCGTGAAAGGCTTCTACCCCTCCGATA<br>TCGCCGTGGAATGGGAGAGCAACGGCCAGCCCGAGAACA<br>ACTACAAGACCACCCCCCCTGTGCTGGACTCCGACGGCTC<br>ATTCTTCCTGTACTCTAAGCTGACAGTGGACAAGTCCGG<br>TGGCAGCAGGGCAACGTGTTCTCCTGCTCCGTGATGCACG<br>AGGCCCTGCACAACCACTACACCCAGAAGTCCCTGTCCCT<br>GTCTCCCGGGGGAGGCGGAGGATCTGGCGGAGGCGGATC<br>CGGTGGTGGCGGATCTGGGGGCGGTGGATCTGAGGTGCA<br>GCTGCTGGAATCTGGGGGAGGACTGGTGCAGCCAGGCGG<br>ATCTCTGAGGCTGTCCTGCGCTGCTTCCGGCTTTACCTTCT<br>CCAGCCACGCCATGAGTTGGGTGCGCCAGGCACCCGGAA<br>AAGGACTGGAATGGGTGTCAGCCATCTGGGCCTCCGGCG<br>AGCAGTACTACGCCGATAGCGTGAAGGGCCGGTTCACCA<br>TCTCTCGGGATAACAGCAAGAATACTCTGTACCTGCAGAT<br>GAACTCCCTGCGCGCTGAAGATACCGCTGTGTATTACTGC<br>GCCAAGGGCTGGCTGGGCAACTTCGATTACTGGGGCCAG<br>GGAACCCTCGTGACTGTCTCGAGCGCTTCTGTGGCCGCTC<br>CCTCCGTGTTCATCTTCCCACCTTCCGACGAGCAGCTGAA<br>GTCCGGCACTGCCTCTGTCGTGTGCCTGCTGAACAACTTC<br>TACCCTCGGGAAGCCAAGGTGCAGTGGAAAGTGGATAAC<br>GCCCTGCAGTCCGGCAACTCCCAGGAATCCGTGACCGAG<br>CAGGACTCCAAGGACAGCACCTACTCCCTGAGCAGCACC<br>CTGACCCTGTCCAAGGCCGACTACGAGAAGCACAAGGTG<br>TACGCCTGTGAAGTGACCCACCAGGGCCTGTCCAGCCCCG<br>TGACCAAGTCCTTCAACCGGGGCGAGTGC |
| 192 | VLCL-Light chain 1 (20B7) (nucleotide sequence) | see Table 13 |
| 215 | VLCH1-Light chain 2 (28H1) (nucleotide sequence) | see above |
| 223 | (20B7) VHCH1-Heavy chain-(28H1) VHCL | QVQLVQSGAEVKKPGSSVKVSCKASGGTFSSYAISWVRQAP<br>GQGLEWMGGIIPIFGTANYAQKFQGRVTITADKSTSTAYME<br>LSSLRSEDTAVYYCARVNYPYSYWGDFDYWGQGTTVTVSS<br>ASTKGPSVFPLAPSSKSTSGGTAALGCLVKDYFPEPVTVSWN<br>SGALTSGVHTFPAVLQSSGLYSLSSVVTVPSSSLGTQTYICNV<br>NHKPSNTKVDKKVEPKSCDKTHTCPPCPAPEAAGGPSVFLFP<br>PKPKDTLMISRTPEVTCVVVDVSHEDPEVKFNWYVDGVEV<br>HNAKTKPREEQYNSTYRVVSVLTVLHQDWLNGKEYKCKVS<br>NKALGAPIEKTISKAKGQPREPQVYTLPPSRDELTKNQVSLT<br>CLVKGFYPSDIAVEWESNGQPENNYKTTPPVLDSDGSFFLYS<br>KLTVDKSRWQQGNVFSCSVMHEALHNHYTQKSLSLSPGGG<br>GGSGGGGSGGGGSGGGGSEVQLLESGGGLVQPGGSLRLSC<br>AASGFTFSSHAMSWVRQAPGKGLEWVSAIWASGEQYYADS<br>VKGRFTISRDNSKNTLYLQMNSLRAEDTAVYYCAKGWLGN<br>FDYWGQGTLVTVSSASVAAPSVFIFPPSDEQLKSGTASVVCL<br>LNNFYPREAKVQWKVDNALQSGNSQESVTEQDSKDSTYSL<br>SSTLTLSKADYEKHKVYACEVTHQGLSSPVTKSFNRGEC |
| 194 | VLCL-Light chain 1 (20B7) | see Table 13 |
| 217 | VLCH1-Light chain 2 (28H1) | see above |

TABLE 25-continued

Sequences of bispecific, bivalent anti-OX40/anti-FAP human IgG1 P329GLALA antigen binding molecules

| SEQ ID NO: | Description | Sequence |
|---|---|---|
| 224 | (CLC-563) VHCH1-Heavy chain-(28H1) VHCL (nucleotide sequence) | GAGGTGCAATTGTTGGAGTCTGGGGGAGGCTTGGTACAG CCTGGGGGGTCCCTGAGACTCTCCTGTGCAGCCTCCGGAT TCACCTTTAGCAGTTATGCCATGAGCTGGGTCCGCCAGGC TCCAGGGAAGGGGCTGGAGTGGGTCTCAGCTATTAGTGG TAGTGGTGGTAGCACATACTACGCAGACTCCGTGAAGGG CCGGTTCACCATCTCCAGAGACAATTCCAAGAACACGCTG TATCTGCAGATGAACAGCCTGAGAGCCGAGGACACGGCC GTATATTACTGTGCGCTTGACGTTGGTGCTTTCGACTACT GGGGCCAAGGAGCCCTGGTCACCGTCTCGAGTGCTAGCA CCAAGGGCCCATCCGTGTTCCCTCTGGCCCCTTCCAGCAA GTCTACCTCTGGCGGCACAGCCGCTCTGGGCTGCCTCGTG AAGGACTACTTCCCCGAGCCTGTGACAGTGTCCTGGAACT CTGGCGCCCTGACATCCGGCGTGCACACCTTTCCAGCTGT GCTGCAGTCCTCCGGCCTGTACTCCCTGTCCTCCGTCGTG ACAGTGCCCTCCAGCTCTCTGGGCACCCAGACCTACATCT GCAACGTGAACCACAAGCCCTCCAACACCAAGGTGGACA AGAAGGTGGAACCCAAGTCCTGCGACAAGACCCACACCT GTCCCCCTTGTCCTGCCCCTGAAGCTGCTGGCGGCCCTAG CGTGTTCCTGTTCCCCCCAAAGCCCAAGGACACCCTGATG ATCTCCCGGACCCCCGAAGTGACCTGCGTGGTGGTGGATG TGTCCCACGAGGACCCTGAAGTGAAGTTCAATTGGTACGT GGACGGCGTGGAAGTGCACAATGCCAAGACCAAGCCTAG AGAGGAACAGTACAACTCCACCTACCGGGTGGTGTCCGT GCTGACCGTGCTGCACCAGGATTGGCTGAACGGCAAAGA GTACAAGTGCAAGGTGTCCAACAAGGCCCTGGGAGCCCC CATCGAAAAGACCATCTCCAAGGCCAAGGGCCAGCCTCG CGAGCCTCAGGTGTACACCCTGCCCCCTAGCAGAGATGA GCTGACCAAGAACCAGGTGTCCCTGACCTGTCTCGTGAAA GGCTTCTACCCTCCGATATCGCCGTGGAATGGGAGAGCA ACGGCCAGCCCGAGAACAACTACAAGACCACCCCCCCTG TGCTGGACTCCGACGGCTCATTCTTCCTGTACTCTAAGCT GACAGTGGACAAGTCCCGGTGGCAGCAGGGCAACGTGTT CTCCTGCTCCGTGATGCACGAGGCCCTGCACAACCACTAC ACCCAGAAGTCCCTGTCCCTGTCTCCCGGGGGAGGCGGA GGATCTGGCGGAGGCGGATCCGGTGGTGGCGGATCTGGG GGCGGTGGATCTGAGGTGCAGCTGCTGGAATCTGGGGGA GGACTGGTGCAGCCAGGCGGATCTCTGAGGCTGTCCTGC GCTGCTTCCGGCTTTACCTTCTCCAGCCACGCCATGAGTT GGGTGCGCCAGGCACCCGGAAAAGGACTGGAATGGGTGT CAGCCATCTGGGCCTCCGGCGAGCAGTACTACGCCGATA GCGTGAAGGGCCGGTTCACCATCTCTCGGGATAACAGCA AGAATACTCTGTACCTGCAGATGAACTCCCTGCGCGCTGA AGATACCGCTGTGTATTACTGCGCCAAGGGCTGGCTGGGC AACTTCGATTACTGGGGCCAGGGAACCCTCGTGACTGTCT CGAGCGCTTCTGTGGCCGCTCCCTCCGTGTTCATCTTCCCA CCTTCCGACGAGCAGCTGAAGTCCGGCACTGCCTCTGTCG TGTGCCTGCTGAACAACTTCTACCCTCGGGAAGCCAAGGT GCAGTGGAAAGTGGATAACGCCCTGCAGTCCGGCAACTC CCAGGAATCCGTGACCGAGCAGGACTCCAAGGACAGCAC CTACTCCCTGAGCAGCACCCTGACCCTGTCCAAGGCCGAC TACGAGAAGCACAAGGTGTACGCCTGTGAAGTGACCCAC CAGGGCCTGTCCAGCCCCGTGACCAAGTCCTTCAACCGGG GCGAGTGC |
| 196 | VLCL-Light chain 1 (CLC-563) (nucleotide sequence) | see Table 13 |
| 215 | VLCH1-Light chain 2 (28H1) (nucleotide sequence) | see above |
| 225 | (CLC-563) VHCH1-Heavy chain-(28H1) VHCL | EVQLLESGGGLVQPGGSLRLSCAASGFTFSSYAMSWVRQAP GKGLEWVSAISGSGGSTYYADSVKGRFTISRDNSKNTLYLQ MNSLRAEDTAVYYCALDVGAFDYWGQGALVTVSSASTKG PSVFPLAPSSKSTSGGTAALGCLVKDYFPEPVTVSWNSGALT SGVHTFPAVLQSSGLYSLSSVVTVPSSSLGTQTYICNVNHKP SNTKVDKKVEPKSCDKTHTCPPCPAPEAAGGPSVFLFPPKPK DTLMISRTPEVTCVVVDVSHEDPEVKFNWYVDGVEVHNAK TKPREEQYNSTYRVVSVLTVLHQDWLNGKEYKCKVSNKAL |

TABLE 25-continued

Sequences of bispecific, bivalent anti-OX40/anti-FAP human
IgG1 P329GLALA antigen binding molecules

| SEQ ID NO: | Description | Sequence |
|---|---|---|
| | | GAPIEKTISKAKGQPREPQVYTLPPSRDELTKNQVSLTCLVK GFYPSDIAVEWESNGQPENNYKTTPPVLDSDGSFFLYSKLTV DKSRWQQGNVFSCSVMHEALHNHYTQKSLSLSPGGGGSG GGGSGGGGSGGGGSEVQLLESGGGLVQPGGSLRLSCAASGF TFSSHAMSWVRQAPGKGLEWVSAIWASGEQYYADSVKGRF TISRDNSKNTLYLQMNSLRAEDTAVYYCAKGWLGNFDYW GQGTLVTVSSASVAAPSVFIFPPSDEQLKSGTASVVCLLNNF YPREAKVQWKVDNALQSGNSQESVTEQDSKDSTYSLSSTLT LSKADYEKHKVYACEVTHQGLSSPVTKSFNRGEC |
| 198 | VLCL-Light chain 1 (CLC-563) | see Table 13 |
| 217 | VLCH1-Light chain 2 (28H1) | see above |
| 226 | (CLC-564) VHCH1-Heavy chain-(28H1) VHCL (nucleotide sequence) | GAGGTGCAATTGTTGGAGTCTGGGGGAGGCTTGGTACAG CCTGGGGGGTCCCTGAGACTCTCCTGTGCAGCCTCCGGAT TCACCTTTAGCAGTTATGCCATGAGCTGGGTCCGCCAGGC TCCAGGGAAGGGGCTGGAGTGGGTCTCAGCTATTAGTGG TAGTGGTGGTAGCACATACTACGCAGACTCCGTGAAGGG CCGGTTCACCATCTCCAGAGACAATTCCAAGAACACGCTG TATCTGCAGATGAACAGCCTGAGAGCCGAGGACACGGCC GTATATTACTGTGCGTTCGACGTTGGTCCGTTCGACTACT GGGGCCAAGGAACCCTGGTCACCGTCTCGAGTGCTAGCA CCAAGGGCCCATCCGTGTTCCCTCTGGCCCCTTCCAGCAA GTCTACCTCTGGCGGCACAGCCGCTCTGGGCTGCCTCGTG AAGGACTACTTCCCCGAGCCTGTGACAGTGTCCTGGAACT CTGGCGCCCTGACATCCGGCGTGCACACCTTTCCAGCTGT GCTGCAGTCCTCCGGCCTGTACTCCCTGTCCTCCGTCGTG ACAGTGCCCTCCAGCTCTCTGGGCACCCAGACCTACATCT GCAACGTGAACCACAAGCCCTCCAACACCAAGGTGGACA AGAAGGTGGAACCCAAGTCCTGCGACAAGACCCACACCT GTCCCCCTTGTCCTGCCCCTGAAGCTGCTGGCGGCCCTAG CGTGTTCCTGTTCCCCCCAAAGCCCAAGGACACCCTGATG ATCTCCCGGACCCCCGAAGTGACCTGCGTGGTGGTGGATG TGTCCCACGAGGACCCTGAAGTGAAGTTCAATTGGTACGT GGACGGCGTGGAAGTGCACAATGCCAAGACCAAGCCTAG AGAGGAACAGTACAACTCCACCTACCGGGTGGTGTCCGT GCTGACCGTGCTGCACCAGGATTGGCTGAACGGCAAAGA GTACAAGTGCAAGGTGTCCAACAAGGCCCTGGGAGCCCC CATCGAAAAGACCATCTCCAAGGCCAAGGGCCAGCCTCG CGAGCCTCAGGTGTACACCCTGCCCCCTAGCAGAGATGA GCTGACCAAGAACCAGGTGTCCCTGACCTGTCTCGTGAAA GGCTTCTACCCCTCCGATATCGCCGTGGAATGGGAGAGCA ACGGCCAGCCCGAGAACAACTACAAGACCACCCCCCCTG TGCTGGACTCCGACGGCTCATTCTTCCTGTACTCTAAGCT GACAGTGGACAAGTCCCGGTGGCAGCAGGGCAACGTGTT CTCCTGCTCCGTGATGCACGAGGCCCTGCACAACCACTAC ACCCAGAAGTCCCTGTCCCTGTCTCCCGGGGAGGCCGGA GGATCTGGCGGAGGCGGATCCGGTGGTGGCGGATCTGGG GGCGGTGGATCTGAGGTGCAGCTGCTGGAATCTGGGGGA GGACTGGTGCAGCCAGGCGGATCTCTGAGGCTGTCCTGC GCTGCTTCCGGCTTTACCTTCTCCAGCCACGCCATGAGTT GGGTGCGCCAGGCACCCGGAAAAGGACTGGAATGGGTGT CAGCCATCTGGGCCTCCGGCGAGCAGTACTACGCCGATA GCGTGAAGGGCCGGTTCACCATCTCTCGGGATAACAGCA AGAATACTCTGTACCTGCAGATGAACTCCCTGCGCGCTGA AGATACCGCTGTGTATTACTGCGCCAAGGGCTGGCTGGGC AACTTCGATTACTGGGGCCAGGGAACCCTCGTGACTGTCT CGAGCGCTTCTGTGGCCGCTCCCTCCGTGTTCATCTTCCCA CCTTCCGACGAGCAGCTGAAGTCCGGCACTGCCTCTGTCG TGTGCCTGCTGAACAACTTCTACCCTCGGGAAGCCAAGGT GCAGTGGAAAGTGGATAACGCCCTGCAGTCCGGCAACTC CCAGGAATCCGTGACCGAGCAGGACTCCAAGGACAGCAC CTACTCCCTGAGCAGCACCCTGACCCTGTCCAAGGCCGAC TACGAGAAGCACAAGGTGTACGCCTGTGAAGTGACCCAC CAGGGCCTGTCCAGCCCCGTGACCAAGTCCTTCAACCGGG GCGAGTGC |

TABLE 25-continued

Sequences of bispecific, bivalent anti-OX40/anti-FAP human
IgG1 P329GLALA antigen binding molecules

| SEQ ID NO: | Description | Sequence |
|---|---|---|
| 200 | VLCL-Light chain 1 (CLC-564) (nucleotide sequence) | see Table 13 |
| 215 | VLCH1-Light chain 2 (28H1) (nucleotide sequence) | see above |
| 227 | (CLC-564) VHCH1-Heavy chain-(28H1) VHCL | EVQLLESGGGLVQPGGSLRLSCAASGFTFSSYAMSWVRQAP GKGLEWVSAISGSGGSTYYADSVKGRFTISRDNSKNTLYLQ MNSLRAEDTAVYYCAFDVGPFDYWGQGTLVTVSSASTKGP SVFPLAPSSKSTSGGTAALGCLVKDYFPEPVTVSWNSGALTS GVHTFPAVLQSSGLYSLSSVVTVPSSSLGTQTYICNVNHKPS NTKVDKKVEPKSCDKTHTCPPCPAPEAAGGPSVFLFPPKPKD TLMISRTPEVTCVVVDVSHEDPEVKFNWYVDGVEVHNAKT KPREEQYNSTYRVVSVLTVLHQDWLNGKEYKCKVSNKALG APIEKTISKAKGQPREPQVYTLPPSRDELTKNQVSLTCLVKG FYPSDIAVEWESNGQPENNYKTTPPVLDSDGSFFLYSKLTVD KSRWQQGNVFSCSVMHEALHNHYTQKSLSLSPGGGGGSGG GGSGGGGSGGGGSEVQLLESGGGLVQPGGSLRLSCAASGFT FSSHAMSWVRQAPGKGLEWVSAIWASGEQYYADSVKGRFT ISRDNSKNTLYLQMNSLRAEDTAVYYCAKGWLGNFDYWG QGTLVTVSSASVAAPSVFIFPPSDEQLKSGTASVVCLLNNFY PREAKVQWKVDNALQSGNSQESVTEQDSKDSTYSLSSTLTL SKADYEKHKVYACEVTHQGLSSPVTKSFNRGEC |
| 202 | VLCL-Light chain 1 (CLC-564) | see Table 13 |
| 217 | VLCH1-Light chain 2 (28H1) | see above |

All genes were transiently expressed under control of a chimeric MPSV promoter consisting of the MPSV core promoter combined with the CMV promoter enhancer fragment. The expression vector also contains the oriP region for episomal replication in EBNA (Epstein Barr Virus Nuclear Antigen) containing host cells.

The bispecific anti-Ox40, anti-FAP constructs were produced by co-transfecting HEK293-EBNA cells with the mammalian expression vectors using polyethylenimine. The cells were transfected with the corresponding expression vectors in a 1:1:1 ratio ("vector heavy chain":"vector light chain1":"vector light chain2").

For production in 500 mL shake flasks, 400 million HEK293 EBNA cells were seeded 24 hours before transfection. For transfection cells were centrifuged for 5 minutes by 210×g, and supernatant was replaced by pre-warmed CD CHO medium. Expression vectors were mixed in 20 mL CD CHO medium to a final amount of 200 µg DNA. After addition of 540 µL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% $CO_2$ atmosphere. After the incubation, 160 mL F17 medium was added and cells were cultured for 24 hours. One day after transfection 1 mM valproic acid and 7% Feed were added. After culturing for 7 days, the cell supernatant was collected by centrifugation for 15 minutes at 210×g. The solution was sterile filtered (0.22 µm filter), supplemented with sodium azide to a final concentration of 0.01% (w/v), and kept at 4° C.

Purification of bispecific constructs from cell culture supernatants was carried out by affinity chromatography using Protein A as described above for purification of antigen-Fc fusions and antibodies.

The protein was concentrated and filtered prior to loading on a HiLoad Superdex 200 column (GE Healthcare) equilibrated with 20 mM Histidine, 140 mM NaCl solution of pH 6.0.

The protein concentration of purified bispecific constructs was determined by measuring the OD at 280 nm, using the molar extinction coefficient calculated on the basis of the amino acid sequence. Purity and molecular weight of the bispecific constructs were analyzed by CE-SDS in the presence and absence of a reducing agent (Invitrogen, USA) using a LabChipGXII (Caliper). The aggregate content of bispecific constructs was analyzed using a TSKgel G3000 SW XL analytical size-exclusion column (Tosoh) equilibrated in a 25 mM K2HPO4, 125 mM NaCl, 200 mM L-Arginine Monohydrocloride, 0.02% (w/v) NaN3, pH 6.7 running buffer at 25° C. (Table 26).

TABLE 26

Biochemical analysis of exemplary bispecific, bivalent anti-Ox40/anti-FAP IgG1 P329G LALA antigen binding molecules

| Clone | Yield [mg/l] | Monomer [%] | CE-SDS (non red) | CE-SDS (red) |
|---|---|---|---|---|
| 8H9/FAP P329GLALA IgG1 2 + 2 | 58 | 100 | 95.3% (254 kDa)<br>3% (237 kDa) | 3.2% (114 kDa)<br>71.3% (90.7 kDa)<br>13.3% (28.9 kDa)<br>11.9% (26.2 kDa) |
| 49B4/FAP P329GLALA IgG1 2 + 2 | 17 | 99 | 98.9% (253 kDa) | 3.% (116 kDa)<br>71.4% (92 kDa)<br>12.9% (28.9 kDa)<br>12.1% (25.7 kDa) |
| 1G4/FAP P329GLALA IgG1 2 + 2 | 0.5 | 99.1 | 93.9% (234 kDa)<br>3.2% (242 kDa)<br>1.2% (244 kDa) | 55.5% (90.6 kDa)<br>20.7% (27 kDa)<br>21.6% (25 kDa) |
| 20B7/FAP P329GLALA IgG1 2 + 2 | 14 | 97.2 | 91.5% (244 kDa)<br>2.3% (227 kDa)<br>1.4% (218 kDa)<br>1.5% (202 kDa) | 54.1% (89 kDa)<br>19% (27 kDa)<br>25% (24 kDa) |

4.2 Generation of Bispecific Monovalent Antigen Binding Molecules Targeting Ox40 and Fibroblast Activation Protein (FAP) (1+1 Format)

Bispecific agonistic Ox40 antibodies with monovalent binding for Ox40 and for FAP were prepared by applying the crossmab technology according to International patent application No. WO 2010/145792 A1 to reduce the formation of wrongly paired light chains.

In this example, a crossed Fab unit (VHCL) of the FAP binder 28H1 was fused to the hole heavy chain of a huIgG1. The Fab against anti-Ox40 was fused to the knob heavy chain. Combination of the targeted anti-FAP-Fc hole with the anti-Ox40-Fc knob chain allows generation of a heterodimer, which includes a FAP binding Fab and an Ox40 binding Fab (FIG. 12B).

The Pro329Gly, Leu234Ala and Leu235Ala mutations have been introduced in the constant region of the heavy chains to abrogate binding to Fc gamma receptors according to the method described in International Patent Appl. Publ. No. WO 2012/130831 A1.

Figure 12B:
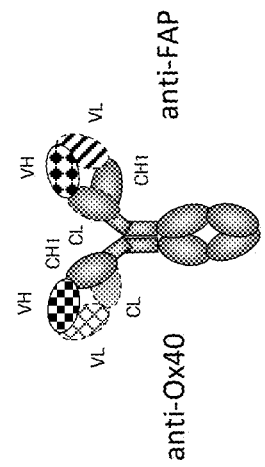
FIG. 12B shows a schematic scheme of an exemplary bispecific, monovalent antigen binding molecule (1+1 format) of the invention comprising one Fab fragment binding to OX40 and one cross-Fab fragment binding to FAP.
Figure 12A:
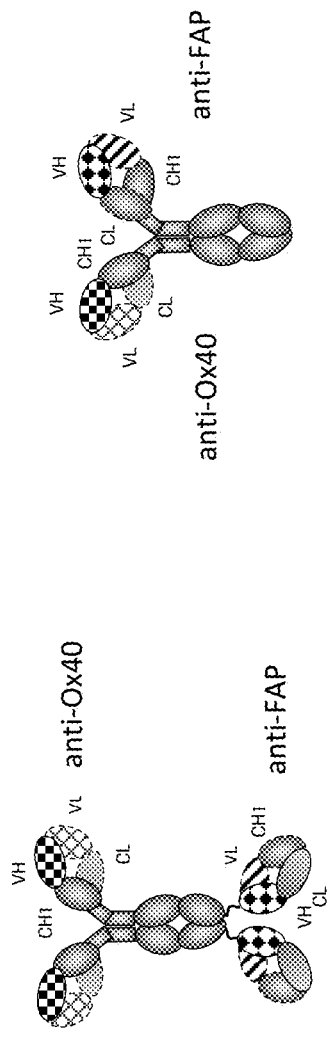
FIG. 12A shows a schematic scheme of an exemplary bispecific, bivalent antigen binding molecule of the invention comprising two Fab fragments binding to OX40 and two cross-Fab fragments binding to FAP (2+2 format).
Figure 12C:
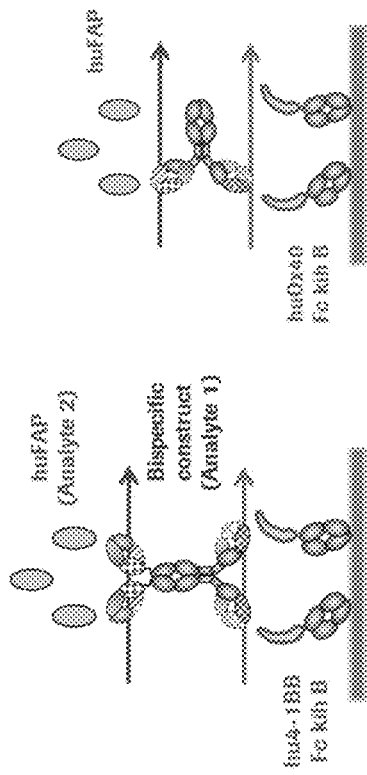
FIG. 12C shows the setup for the SPR experiments showing simultaneous binding to immobilized human OX40 or human 4-1BB and human FAP.

The resulting bispecific, monovalent construct is depicted in FIG. 12B and the nucleotide and amino acid sequences can be found in Table 27.

TABLE 27 cDNA and amino acid sequences of mature bispecific monovalent anti-Ox40/anti-FAP huIgG1 P329GLALA kih antibodies

| SEQ ID NO: | Description | Sequence |
|---|---|---|
| 228 | (28H1) VHCL-heavy chain hole (nucleotide sequence) | GAAGTGCAGCTGCTGGAATCCGGCGGAGGCCTGGTGC<br>AGCCTGGCGGATCTCTGAGACTGTCCTGCGCCGCCTCC<br>GGCTTCACCTTCTCCTCCCACGCCATGTCCTGGGTCCG<br>ACAGGCTCCTGGCAAAGGCCTGGAATGGGTGTCCGCC<br>ATCTGGGCCTCCGGCGAGCAGTACTACGCCGACTCTGT<br>GAAGGGCCGGTTCACCATCTCCCGGGACAACTCCAAG<br>AACACCCTGTACCTGCAGATGAACTCCCTGCGGGCCGA<br>GGACACCGCCGTGTACTACTGTGCCAAGGGCTGGCTGG<br>GCAACTTCGACTACTGGGGACAGGGCACCCTGGTCACC<br>GTGTCCAGCGCTAGCGTGGCCGCTCCCAGCGTGTTCAT<br>CTTCCCACCCAGCGACGAGCAGCTGAAGTCCGGCACA<br>GCCAGCGTGGTGTGCCTGCTGAACAACTTCTACCCCCG<br>CGAGGCCAAGGTGCAGTGGAAGGTGGACAACGCCCTG<br>CAGAGCGGCAACAGCCAGGAATCCGTGACCGAGCAGG<br>ACAGCAAGGACTCCACCTACAGCCTGAGCAGCACCCT<br>GACCCTGAGCAAGGCCGACTACGAGAAGCACAAGGTG<br>TACGCCTGCGAAGTGACCCACCAGGGCCTGTCCAGCCC<br>CGTGACCAAGAGCTTCAACCGGGGCGAGTGCGACAAG<br>ACCCACACCTGTCCCCCTTGCCCTGCCCCTGAAGCTGC<br>TGGTGGCCCTTCCGTGTTCCTGTTCCCCCCAAAGCCCA<br>AGGACACCCTGATGATCAGCCGGACCCCCGAAGTGAC<br>CTGCGTGGTGGTCGATGTGTCCCACGAGGACCCTGAAG<br>TGAAGTTCAATTGGTACGTGGACGGCGTGGAAGTGCA<br>CAATGCCAAGACCAAGCCGCGGGAGGAGCAGTACAAC<br>AGCACGTACCGTGTGGTCAGCGTCCTCACCGTCCTGCA<br>CCAGGACTGGCTGAATGGCAAGGAGTACAAGTGCAAG<br>GTCTCCAACAAAGCCCTCGGCGCCCCCATCGAGAAAA<br>CCATCTCCAAAGCCAAAGGGCAGCCCCGAGAACCACA<br>GGTGTGCACCCTGCCCCCATCCCGGGATGAGCTGACCA<br>AGAACCAGGTCAGCCTCTCGTGCGCAGTCAAAGGCTTC<br>TATCCCAGCGACATCGCCGTGGAGTGGGAGAGCAATG<br>GGCAGCCGGAGAACAACTACAAGACCACGCCTCCCGT |

TABLE 27-continued cDNA and amino acid sequences of mature bispecific monovalent
anti-Ox40/anti-FAP huIgG1 P329GLALA kih antibodies

| SEQ ID NO | Description | Sequence |
|---|---|---|
|  |  | GCTGGACTCCGACGGCTCCTTCTTCCTCGTGAGCAAGC TCACCGTGGACAAGAGCAGGTGGCAGCAGGGGAACGT CTTCTCATGCTCCGTGATGCATGAGGCTCTGCACAACC ACTACACGCAGAAGAGCCTCTCCCTGTCTCCGGGTAAA |
| 215 | (28H1) VLCH1-Light chain 2 (nucleotide sequence) | see Table 25 |
| 229 | (28H1) VHCL-heavy chain hole | EVQLLESGGGLVQPGGSLRLSCAASGFTFSSHAMSWVRQ APGKGLEWVSAIWASGEQYYADSVKGRFTISRDNSKNTL YLQMNSLRAEDTAVYYCAKGWLGNFDYWGQGTLVTVS SASVAAPSVFIFPPSDEQLKSGTASVVCLLNNFYPREAKV QWKVDNALQSGNSQESVTEQDSKDSTYSLSSTLTLSKAD YEKHKVYACEVTHQGLSSPVTKSFNRGECDKTHTCPPCP APEAAGGPSVFLFPPKPKDTLMISRTPEVTCVVVDVSHED PEVKFNWYVDGVEVHNAKTKPREEQYNSTYRVVSVLTV LHQDWLNGKEYKCKVSNKALGAPIEKTISKAKGQPREPQ VCTLPPSRDELTKNQVSLSCAVKGFYPSDIAVEWESNGQP ENNYKTTPPVLDSDGSFFLVSKLTVDKSRWQQGNVFSCS VMHEALHNHYTQKSLSLSPGK |
| 217 | (28H1) VLCH1-Light chain 2 | see Table 25 |
| 302 | (8H9) VHCH1-heavy chain knob (nucleotide sequence) | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTCGAGTGGATGGGAGG GATCATCCCTATCTTTGGTACAGCAAACTACGCACAGA AGTTCCAGGGCAGGGTCACCATTACTGCAGACAAATCC ACGAGCACAGCCTACATGGAGCTGAGCAGCCTGAGAT CTGAGGACACCGCCGTGTATTACTGTGCGAGAGAATAC GGTTGGATGGACTACTGGGGCCAAGGGACCACCGTGA CCGTCTCCTCA GCTAGCACCAAGGGCCCCTAGCGTGTTCCCTCTGGCCCC TAGCAGCAAGAGCACAAGTGGAGGAACAGCCGCCCTG GGCTGCCTGGTCAAGGACTACTTCCCCGAGCCCGTGAC CGTGTCCTGGAATTCTGGCGCCCTGACAAGCGGCGTGC ACACATTTCCAGCCGTGCTGCAGAGCAGCGGCCTGTAC TCTCTGAGCAGCGTCGTGACCGTGCCCTCTAGCTCTCT GGGCACCCAGACCTACATCTGCAACGTGAACCACAAG CCCAGCAACACCAAAGTGGACAAGAAGGTGGAACCCA AGAGCTGCGACAAGACCCACACCTGTCCCCCTTGCCCT GCCCCTGAAGCTGCTGGTGGCCCTTCCGTGTTCCTGTTC CCCCCAAAGCCCAAGGACACCCTGATGATCAGCCGGA CCCCCGAAGTGACCTGCGTGGTGGTCGATGTGTCCCAC GAGGACCCTGAAGTGAAGTTCAATTGGTACGTGGACG GCGTGGAAGTGCACAATGCCAAGACCAAGCCGCGGGA GGAGCAGTACAACAGCACGTACCGTGTGGTCAGCGTC CTCACCGTCCTGCACCAGGACTGGCTGAATGGCAAGG AGTACAAGTGCAAGGTCTCCAACAAAGCCCTCGGCGC CCCCATCGAGAAAACCATCTCCAAAGCCAAAGGGCAG CCCCGAGAACCACAGGTGTACACCCTGCCCCCATGCCG GGATGAGCTGACCAAGAACCAGGTCAGCCTGTGGTGC CTGGTCAAAGGCTTCTATCCCAGCGACATCGCCGTGGA GTGGGAGAGCAATGGGCAGCCGGAGAACAACTACAAG ACCACGCCTCCCGTGCTGGACTCCGACGGCTCCTTCTT CCTCTACAGCAAGCTCACCGTGGACAAGAGCAGGTGG CAGCAGGGGAACGTCTTCTCATGCTCCGTGATGCATGA GGCTCTGCACAACCACTACACGCAGAAGAGCCTCTCCC TGTCTCCGGGTAAA |
| 180 | (8H9) VLCL-Light chain 1 (nucleotide sequence) | see Table 13 |
| 303 | (8H9) VHCH1-heavy chain knob | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCAREYGWMDYWGQGTTVTVSS ASTKGPSVFPLAPSSKSTSGGTAALGCLVKDYFPEPVTVS WNSGALTSGVHTFPAVLQSSGLYSLSSVVTVPSSSLGTQT YICNVNHKPSNTKVDKKVEPKSCDKTHTCPPCPAPEAAG GPSVFLFPPKPKDTLMISRTPEVTCVVVDVSHEDPEVKFN |

TABLE 27-continued cDNA and amino acid sequences of mature bispecific monovalent
anti-Ox40/anti-FAP huIgG1 P329GLALA kih antibodies

| SEQ ID NO: | Description | Sequence |
|---|---|---|
| | | WYVDGVEVHNAKTKPREEQYNSTYRVVSVLTVLHQDW
LNGKEYKCKVSNKALGAPIEKTISKAKGQPREPQVYTLPP
CRDELTKNQVSLWCLVKGFYPSDIAVEWESNGQPENNY
KTTPPVLDSDGSFFLYSKLTVDKSRWQQGNVFSCSVMHE
ALHNHYTQKSLSLSPGK |
| 182 | (8H9) VLCL-Light chain 1 | see Table 13 |
| 230 | (49B4) VHCH1-heavy chain knob (nucleotide sequence) | AGGTGCAATTGGTGCAGTCTGGGGCTGAGGTGAAGAA
GCCTGGGTCCTCGGTGAAGGTCTCCTGCAAGGCCTCCG
GAGGCACATTCAGCAGCTACGCTATAAGCTGGGTGCG
ACAGGCCCCTGGACAAGGGCTCGAGTGGATGGGAGGG
ATCATCCCTATCTTTGGTACAGCAAACTACGCACAGAA
GTTCCAGGGCAGGGTCACCATTACTGCAGACAAATCCA
CGAGCACAGCCTACATGGAGCTGAGCAGCCTGAGATC
TGAGGACACCGCCGTGTATTACTGTGCGAGAGAATACT
ACCGTGGTCCGTACGACTACTGGGGCCAAGGGACCAC
CGTGACCGTCTCCTCA
GCTAGCACCAAGGGCCCATCGGTGTTCCCTCTGGCCCC
TAGCAGCAAGAGCACAAGTGGAGGAACAGCCGCCCTG
GGCTGCCTGGTCAAGGACTACTTCCCCGAGCCCGTGAC
CGTGTCCTGGAATTCTGGCGCCCTGACAAGCGGCGTGC
ACACATTTCCAGCCGTGCTGCAGAGCAGCGGCCTGTAC
TCTCTGAGCAGCGTCGTGACCGTGCCCTCTAGCTCTCT
GGGCACCCAGACCTACATCTGCAACGTGAACCACAAG
CCCAGCAACACCAAAGTGGACAAGAAGGTGGAACCCA
AGAGCTGCGACAAGACCCACACCTGTCCCCCTTGCCCT
GCCCCTGAAGCTGCTGGTGGCCCTTCCGTGTTCCTGTTC
CCCCCAAAGCCCAAGGACACCCTGATGATCAGCCGGA
CCCCCGAAGTGACCTGCGTGGTGGTCGATGTGTCCCAC
GAGGACCCTGAAGTGAAGTTCAATTGGTACGTGGACG
GCGTGGAAGTGCACAATGCCAAGACCAAGCCGCGGGA
GGAGCAGTACAACAGCACGTACCGTGTGGTCAGCGTC
CTCACCGTCCTGCACCAGGACTGGCTGAATGGCAAGG
AGTACAAGTGCAAGGTCTCCAACAAAGCCCTCGGCGC
CCCCATCGAGAAAACCATCTCCAAAGCCAAAGGGCAG
CCCCGAGAACCACAGGTGTACACCCTGCCCCCATGCCG
GGATGAGCTGACCAAGAACCAGGTCAGCCTGTGGTGC
CTGGTCAAAGGCTTCTATCCCAGCGACATCGCCGTGGA
GTGGGAGAGCAATGGGCAGCCGGAGAACAACTACAAG
ACCACGCCTCCCGTGCTGGACTCCGACGGCTCCTTCTT
CCTCTACAGCAAGCTCACCGTGGACAAGAGCAGGTGG
CAGCAGGGGAACGTCTTCTCATGCTCCGTGATGCATGA
GGCTCTGCACAACCACTACACGCAGAAGAGCCTCTCCC
TGTCTCCGGGTAAA |
| 184 | (49B4) VLCL-Light chain 1 (nucleotide sequence) | see Table 13 |
| 231 | (49B4) VHCH1-heavy chain knob | QVQLVQSGAEVKKPGSSVKVSCKASGGTFSSYAISWVRQ
APGQGLEWMGGIIPIFGTANYAQKFQGRVTITADKSTSTA
YMELSSLRSEDTAVYYCAREYYRGPYDYWGQGTTVTVSS
ASTKGPSVFPLAPSSKSTSGGTAALGCLVKDYFPEPVTVS
WNSGALTSGVHTFPAVLQSSGLYSLSSVVTVPSSSLGTQT
YICNVNHKPSNTKVDKKVEPKSCDKTHTCPPCPAPEAAG
GPSVFLFPPKPKDTLMISRTPEVTCVVVDVSHEDPEVKFN
WYVDGVEVHNAKTKPREEQYNSTYRVVSVLTVLHQDW
LNGKEYKCKVSNKALGAPIEKTISKAKGQPREPQVYTLPP
CRDELTKNQVSLWCLVKGFYPSDIAVEWESNGQPENNY
KTTPPVLDSDGSFFLYSKLTVDKSRWQQGNVFSCSVMHE
ALHNHYTQKSLSLSPGK |
| 186 | (49B4) VLCL-Light chain 1 | see Table 13 |
| 232 | (1G4) VHCH1-heavy chain knob (nucleotide sequence) | CAGGTGCAATTGGTGCAGTCTGGGGCTGAGGTGAAGA
AGCCTGGGTCCTCGGTGAAGGTCTCCTGCAAGGCCTCC
GGAGGCACATTCAGCAGCTACGCTATAAGCTGGGTGC
GACAGGCCCCTGGACAAGGGCTCGAGTGGATGGGAGG
GATCATCCCTATCTTTGGTACAGCAAACTACGCACAGA
AGTTCCAGGGCAGGGTCACCATTACTGCAGACAAATCC
ACGAGCACAGCCTACATGGAGCTGAGCAGCCTGAGAT |

TABLE 27-continued cDNA and amino acid sequences of mature bispecific monovalent
anti-Ox40/anti-FAP huIgG1 P329GLALA kih antibodies

| SEQ ID NO: | Description | Sequence |
|---|---|---|
| | | CTGAGGACACCGCCGTGTATTACTGTGCGAGAGAATAC<br>GGTTCTATGGACTACTGGGGCCAAGGGACCACCGTGA<br>CCGTCTCCTCA<br>GCTAGCACCAAGGGCCCTAGCGTGTTCCCTCTGGCCCC<br>TAGCAGCAAGAGCACAAGTGGAGGAACAGCCGCCCTG<br>GGCTGCCTGGTCAAGGACTACTTCCCCGAGCCCGTGAC<br>CGTGTCCTGGAATTCTGGCGCCCTGACAAGCGGCGTGC<br>ACACATTTCCAGCCGTGCTGCAGAGCAGCGGCCTGTAC<br>TCTCTGAGCAGCGTCGTGACCGTGCCCTCTAGCTCTCT<br>GGGCACCCAGACCTACATCTGCAACGTGAACCACAAG<br>CCCAGCAACACCAAAGTGGACAAGAAGGTGGAACCCA<br>AGAGCTGCGACAAGACCCACACCTGTCCCCCTTGCCCT<br>GCCCCTGAAGCTGCTGGTGGCCCTTCCGTGTTCCTGTTC<br>CCCCCAAAGCCCAAGGACACCCTGATGATCAGCCGGA<br>CCCCCGAAGTGACCTGCGTGGTGGTCGATGTGTCCCAC<br>GAGGACCCTGAAGTGAAGTTCAATTGGTACGTGGACG<br>GCGTGGAAGTGCACAATGCCAAGACCAAGCCGCGGGA<br>GGAGCAGTACAACAGCACGTACCGTGTGGTCAGCGTC<br>CTCACCGTCCTGCACCAGGACTGGCTGAATGGCAAGG<br>AGTACAAGTGCAAGGTCTCCAACAAAGCCCTCGGCGC<br>CCCCATCGAGAAAACCATCTCCAAAGCCAAAGGGCAG<br>CCCCGAGAACCACAGGTGTACACCCTGCCCCCATGCCG<br>GGATGAGCTGACCAAGAACCAGGTCAGCCTGTGGTGC<br>CTGGTCAAAGGCTTCTATCCCAGCGACATCGCCGTGGA<br>GTGGGAGAGCAATGGGCAGCCGGAGAACAACTACAAG<br>ACCACGCCTCCCGTGCTGGACTCCGACGGCTCCTTCTT<br>CCTCTACAGCAAGCTCACCGTGGACAAGAGCAGGTGG<br>CAGCAGGGGAACGTCTTCTCATGCTCCGTGATGCATGA<br>GGCTCTGCACAACCACTACACGCAGAAGAGCCTCTCCC<br>TGTCTCCGGGTAAA |
| 188 | (1G4) VLCL-Light chain 1 (nucleotide sequence) | see Table 13 |
| 233 | (1G4) VHCH1-heavy chain knob | QVQLVQSGAEVKKPGSSVKVSCKASGGTFSSYAISWVRQ<br>APGQGLEWMGGIIPIFGTANYAQKFQGRVTITADKSTSTA<br>YMELSSLRSEDTAVYYCAREYGSMDYWGQGTTVTVSS<br>ASTKGPSVFPLAPSSKSTSGGTAALGCLVKDYFPEPVTVS<br>WNSGALTSGVHTFPAVLQSSGLYSLSSVVTVPSSSLGTQT<br>YICNVNHKPSNTKVDKKVEPKSCDKTHTCPPCPAPEAAG<br>GPSVFLFPPKPKDTLMISRTPEVTCVVVDVSHEDPEVKFN<br>WYVDGVEVHNAKTKPREEQYNSTYRVVSVLTVLHQDW<br>LNGKEYKCKVSNKALGAPIEKTISKAKGQPREPQVYTLPP<br>CRDELTKNQVSLWCLVKGFYPSDIAVEWESNGQPENNY<br>KTTPPVLDSDGSFFLYSKLTVDKSRWQQGNVFSCSVMHE<br>ALHNHYTQKSLSLSPGK |
| 190 | (1G4) VLCL-Light chain 1 | see Table 13 |
| 234 | (20B7) VHCH1-heavy chain knob (nucleotide sequence) | CAGGTGCAATTGGTGCAGTCTGGGGCTGAGGTGAAGA<br>AGCCTGGGTCCTCGGTGAAGGTCTCCTGCAAGGCCTCC<br>GGAGGCACATTCAGCAGCTACGCTATAAGCTGGGTGC<br>GACAGGCCCCTGGACAAGGGCTCGAGTGGATGGGAGG<br>GATCATCCCTATCTTTGGTACAGCAAACTACGCACAGA<br>AGTTCCAGGGCAGGGTCACCATTACTGCAGACAAATCC<br>ACGAGCACAGCCTACATGGAGCTGAGCAGCCTGAGAT<br>CTGAGGACACCGCCGTGTATTACTGTGCGAGAGTTAAC<br>TACCCGTACTCTTACTGGGGTGACTTCGACTACTGGGG<br>CCAAGGGACCACCGTGACCGTCTCCTCA<br>GCTAGCACCAAGGGCCCTAGCGTGTTCCCTCTGGCCCC<br>TAGCAGCAAGAGCACAAGTGGAGGAACAGCCGCCCTG<br>GGCTGCCTGGTCAAGGACTACTTCCCCGAGCCCGTGAC<br>CGTGTCCTGGAATTCTGGCGCCCTGACAAGCGGCGTGC<br>ACACATTTCCAGCCGTGCTGCAGAGCAGCGGCCTGTAC<br>TCTCTGAGCAGCGTCGTGACCGTGCCCTCTAGCTCTCT<br>GGGCACCCAGACCTACATCTGCAACGTGAACCACAAG<br>CCCAGCAACACCAAAGTGGACAAGAAGGTGGAACCCA<br>AGAGCTGCGACAAGACCCACACCTGTCCCCCTTGCCCT<br>GCCCCTGAAGCTGCTGGTGGCCCTTCCGTGTTCCTGTTC<br>CCCCCAAAGCCCAAGGACACCCTGATGATCAGCCGGA<br>CCCCCGAAGTGACCTGCGTGGTGGTCGATGTGTCCCAC<br>GAGGACCCTGAAGTGAAGTTCAATTGGTACGTGGACG |

TABLE 27-continued cDNA and amino acid sequences of mature bispecific monovalent
anti-Ox40/anti-FAP huIgG1 P329GLALA kih antibodies

| SEQ ID NO | Description | Sequence |
|---|---|---|
| | | GCGTGGAAGTGCACAATGCCAAGACCAAGCCGCGGGA<br>GGAGCAGTACAACAGCACGTACCGTGTGGTCAGCGTC<br>CTCACCGTCCTGCACCAGGACTGGCTGAATGGCAAGG<br>AGTACAAGTGCAAGGTCTCCAACAAAGCCCTCGGCGC<br>CCCCATCGAGAAAACCATCTCCAAAGCCAAAGGGCAG<br>CCCCGAGAACCACAGGTGTACACCCTGCCCCCATGCCG<br>GGATGAGCTGACCAAGAACCAGGTCAGCCTGTGGTGC<br>CTGGTCAAAGGCTTCTATCCCAGCGACATCGCCGTGGA<br>GTGGGAGAGCAATGGGCAGCCGGAGAACAACTACAAG<br>ACCACGCCTCCCGTGCTGGACTCCGACGGCTCCTTCTT<br>CCTCTACAGCAAGCTCACCGTGGACAAGAGCAGGTGG<br>CAGCAGGGGAACGTCTTCTCATGCTCCGTGATGCATGA<br>GGCTCTGCACAACCACTACACGCAGAAGAGCCTCTCCC<br>TGTCTCCGGGTAAA |
| 192 | (20B7) VLCL-Light chain 1 (nucleotide sequence) | see Table 13 |
| 235 | (20B7) VHCH1-heavy chain knob | QVQLVQSGAEVKKPGSSVKVSCKASGGTFSSYAISWVRQ<br>APGQGLEWMGGIIPIFGTANYAQKFQGRVTITADKSTSTA<br>YMELSSLRSEDTAVYYCARVNYPYSYWGDFDYWGQGT<br>TVTVSS<br>ASTKGPSVFPLAPSSKSTSGGTAALGCLVKDYFPEPVTVS<br>WNSGALTSGVHTFPAVLQSSGLYSLSSVVTVPSSSLGTQT<br>YICNVNHKPSNTKVDKKVEPKSCDKTHTCPPCPAPEAAG<br>GPSVFLFPPKPKDTLMISRTPEVTCVVVDVSHEDPEVKFN<br>WYVDGVEVHNAKTKPREEQYNSTYRVVSVLTVLHQDW<br>LNGKEYKCKVSNKALGAPIEKTISKAKGQPREPQVYTLPP<br>CRDELTKNQVSLWCLVKGFYPSDIAVEWESNGQPENNY<br>KTTPPVLDSDGSFFLYSKLTVDKSRWQQGNVFSCSVMHE<br>ALHNHYTQKSLSLSPGK |
| 194 | (20B7) VLCL-Light chain 1 | see Table 13 |
| 236 | (CLC-563) VHCH1-heavy chain knob (nucleotide sequence) | GAGGTGCAATTGTTGGAGTCTGGGGGAGGCTTGGTAC<br>AGCCTGGGGGGTCCCTGAGACTCTCCTGTGCAGCCTCC<br>GGATTCACCTTTAGCAGTTATGCCATGAGCTGGGTCCG<br>CCAGGCTCCAGGGAAGGGGCTGGAGTGGGTCTCAGCT<br>ATTAGTGGTAGTGGTGGTAGCACATACTACGCAGACTC<br>CGTGAAGGGCCGGTTCACCATCTCCAGAGACAATTCCA<br>AGAACACGCTGTATCTGCAGATGAACAGCCTGAGAGC<br>CGAGGACACGGCCGTATATTACTGTGCGCTTGACGTTG<br>GTGCTTTCGACTACTGGGGCCAAGGAGCCCTGGTCACC<br>GTCTCGAGT<br>GCTAGCACCAAGGGCCCTAGCGTGTTCCCTCTGGCCCC<br>TAGCAGCAAGAGCACAAGTGGAGGAACAGCCGCCCTG<br>GGCTGCCTGGTCAAGGACTACTTCCCCGAGCCCGTGAC<br>CGTGTCCTGGAATTCTGGCGCCCTGACAAGCGGCGTGC<br>ACACATTTCCAGCCGTGCTGCAGAGCAGCGGCCTGTAC<br>TCTCTGAGCAGCGTCGTGACCGTGCCCTCTAGCTCTCT<br>GGGCACCCAGACCTACATCTGCAACGTGAACCACAAG<br>CCCAGCAACACCAAAGTGGACAAGAAGGTGGAACCCA<br>AGAGCTGCGACAAGACCCACACCTGTCCCCCTTGCCCT<br>GCCCCTGAAGCTGCTGGTGGCCCTTCCGTGTTCCTGTTC<br>CCCCCAAAGCCCAAGGACACCCTGATGATCAGCCGGA<br>CCCCCGAAGTGACCTGCGTGGTGGTCGATGTGTCCCAC<br>GAGGACCCTGAAGTGAAGTTCAATTGGTACGTGGACG<br>GCGTGGAAGTGCACAATGCCAAGACCAAGCCGCGGGA<br>GGAGCAGTACAACAGCACGTACCGTGTGGTCAGCGTC<br>CTCACCGTCCTGCACCAGGACTGGCTGAATGGCAAGG<br>AGTACAAGTGCAAGGTCTCCAACAAAGCCCTCGGCGC<br>CCCCATCGAGAAAACCATCTCCAAAGCCAAAGGGCAG<br>CCCCGAGAACCACAGGTGTACACCCTGCCCCCATGCCG<br>GGATGAGCTGACCAAGAACCAGGTCAGCCTGTGGTGC<br>CTGGTCAAAGGCTTCTATCCCAGCGACATCGCCGTGGA<br>GTGGGAGAGCAATGGGCAGCCGGAGAACAACTACAAG<br>ACCACGCCTCCCGTGCTGGACTCCGACGGCTCCTTCTT<br>CCTCTACAGCAAGCTCACCGTGGACAAGAGCAGGTGG<br>CAGCAGGGGAACGTCTTCTCATGCTCCGTGATGCATGA<br>GGCTCTGCACAACCACTACACGCAGAAGAGCCTCTCCC<br>TGTCTCCGGGTAAA |

TABLE 27-continued cDNA and amino acid sequences of mature bispecific monovalent
anti-Ox40/anti-FAP huIgG1 P329GLALA kih antibodies

| SEQ ID NO: | Description | Sequence |
|---|---|---|
| 196 | (CLC-563) VLCL-Light chain 1 (nucleotide sequence) | see Table 13 |
| 237 | (CLC-563) VHCH1-heavy chain knob | EVQLLESGGGLVQPGGSLRLSCAASGFTFSSYAMSWVRQ APGKGLEWVSAISGSGGSTYYADSVKGRFTISRDNSKNTL YLQMNSLRAEDTAVYYCALDVGAFDYWGQGALVTVSS ASTKGPSVFPLAPSSKSTSGGTAALGCLVKDYFPEPVTVS WNSGALTSGVHTFPAVLQSSGLYSLSSVVTVPSSSLGTQT YICNVNHKPSNTKVDKKVEPKSCDKTHTCPPCPAPEAAG GPSVFLFPPKPKDTLMISRTPEVTCVVVDVSHEDPEVKFN WYVDGVEVHNAKTKPREEQYNSTYRVVSVLTVLHQDW LNGKEYKCKVSNKALGAPIEKTISKAKGQPREPQVYTLPP CRDELTKNQVSLWCLVKGFYPSDIAVEWESNGQPENNY KTTPPVLDSDGSFFLYSKLTVDKSRWQQGNVFSCSVMHE ALHNHYTQKSLSLSPGK |
| 198 | (CLC-563) VLCL-Light chain 1 | see Table 13 |
| 238 | (CLC-564) VHCH1-heavy chain knob (nucleotide sequence) | GAGGTGCAATTGTTGGAGTCTGGGGGAGGCTTGGTAC AGCCTGGGGGGTCCCTGAGACTCTCCTGTGCAGCCTCC GGATTCACCTTTAGCAGTTATGCCATGAGCTGGGTCCG CCAGGCTCCAGGGAAGGGGCTGGAGTGGGTCTCAGCT ATTAGTGGTAGTGGTGGTAGCACATACTACGCAGACTC CGTGAAGGGCCGGTTCACCATCTCCAGAGACAATTCCA AGAACACGCTGTATCTGCAGATGAACAGCCTGAGAGC CGAGGACACGGCCGTATATTACTGTGCGTTCGACGTTG GTCCGTTCGACTACTGGGGCCAAGGAACCCTGGTCACC GTCTCGAGT GCTAGCACCAAGGGCCCCTAGCGTGTTCCCTCTGGCCCC TAGCAGCAAGAGCACAAGTGGAGGAACAGCCGCCCTG GGCTGCCTGGTCAAGGACTACTTCCCCGAGCCCGTGAC CGTGTCCTGGAATTCTGGCGCCCTGACAAGCGGCGTGC ACACATTTCCAGCCGTGCTGCAGAGCAGCGGCCTGTAC TCTCTGAGCAGCGTCGTGACCGTGCCCTCTAGCTCTCT GGGCACCCAGACCTACATCTGCAACGTGAACCACAAG CCCAGCAACACCAAAGTGGACAAGAAGGTGGAACCCA AGAGCTGCGACAAGACCCACACCTGTCCCCCTTGCCCT GCCCCTGAAGCTGCTGGTGGCCCTTCCGTGTTCCTGTTC CCCCCAAAGCCCAAGGACACCCTGATGATCAGCCGGA CCCCCGAAGTGACCTGCGTGGTGGTCGATGTGTCCCAC GAGGACCCTGAAGTGAAGTTCAATTGGTACGTGGACG GCGTGGAAGTGCACAATGCCAAGACCAAGCCGCGGGA GGAGCAGTACAACAGCACGTACCGTGTGGTCAGCGTC CTCACCGTCCTGCACCAGGACTGGCTGAATGGCAAGG AGTACAAGTGCAAGGTCTCCAACAAAGCCCTCGGCGC CCCCATCGAGAAAACCATCTCCAAAGCCAAAGGGCAG CCCCGAGAACCACAGGTGTACACCCTGCCCCCATGCCG GGATGAGCTGACCAAGAACCAGGTCAGCCTGTGGTGC CTGGTCAAAGGCTTCTATCCCAGCGACATCGCCGTGGA GTGGGAGAGCAATGGGCAGCCGGAGAACAACTACAAG ACCACGCCTCCCGTGCTGGACTCCGACGGCTCCTTCTT CCTCTACAGCAAGCTCACCGTGGACAAGAGCAGGTGG CAGCAGGGGAACGTCTTCTCATGCTCCGTGATGCATGA GGCTCTGCACAACCACTACACGCAGAAGAGCCTCTCCC TGTCTCCGGGTAAA |
| 200 | (CLC-564) VLCL-Light chain 1 (nucleotide sequence) | see Table 13 |
| 239 | (CLC-564) VHCH1-heavy chain knob | EVQLLESGGGLVQPGGSLRLSCAASGFTFSSYAMSWVRQ APGKGLEWVSAISGSGGSTYYADSVKGRFTISRDNSKNTL YLQMNSLRAEDTAVYYCAFDVGPFDYWGQGTLVTVSS ASTKGPSVFPLAPSSKSTSGGTAALGCLVKDYFPEPVTVS WNSGALTSGVHTFPAVLQSSGLYSLSSVVTVPSSSLGTQT YICNVNHKPSNTKVDKKVEPKSCDKTHTCPPCPAPEAAG GPSVFLFPPKPKDTLMISRTPEVTCVVVDVSHEDPEVKFN WYVDGVEVHNAKTKPREEQYNSTYRVVSVLTVLHQDW LNGKEYKCKVSNKALGAPIEKTISKAKGQPREPQVYTLPP CRDELTKNQVSLWCLVKGFYPSDIAVEWESNGQPENNY KTTPPVLDSDGSFFLYSKLTVDKSRWQQGNVFSCSVMHE ALHNHYTQKSLSLSPGK |

TABLE 27-continued cDNA and amino acid sequences of mature bispecific monovalent
anti-Ox40/anti-FAP huIgG1 P329GLALA kih antibodies

| SEQ ID NO | Description | Sequence |
|---|---|---|
| 202 | (CLC-564) VLCL- Light chain 1 | see Table 13 |

All genes were transiently expressed under control of a chimeric MPSV promoter consisting of the MPSV core promoter combined with the CMV promoter enhancer fragment. The expression vector also contains the oriP region for episomal replication in EBNA (Epstein Barr Virus Nuclear Antigen) containing host cells.

The bispecific anti-Ox40, anti-FAP constructs were produced by co-transfecting HEK293-EBNA cells with the mammalian expression vectors using polyethylenimine. The cells were transfected with the corresponding expression vectors in a 1:1:1:1 ratio ("vector heavy chain hole": "vector heavy chain knob":"vector light chain1": "vector light chain2").

For production in 500 mL shake flasks, 400 million HEK293 EBNA cells were seeded 24 hours before transfection. For transfection cells were centrifuged for 5 minutes by 210×g, and supernatant was replaced by pre-warmed CD CHO medium. Expression vectors were mixed in 20 mL CD CHO medium to a final amount of 200 µg DNA. After addition of 540 µL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% $CO_2$ atmosphere. After the incubation, 160 mL F17 medium was added and cells were cultured for 24 hours. One day after transfection 1 mM valproic acid and 7% Feed were added. After culturing for 7 days, the cell supernatant was collected by centrifugation for 15 minutes at 210×g. The solution was sterile filtered (0.22 µm filter), supplemented with sodium azide to a final concentration of 0.01% (w/v), and kept at 4° C.

Purification of the bispecific antigen binding molecules from cell culture supernatants was carried out by affinity chromatography using Protein A as described above for purification of antigen-Fc fusions and antibodies.

The protein was concentrated and filtered prior to loading on a HiLoad Superdex 200 column (GE Healthcare) equilibrated with 20 mM Histidine, 140 mM NaCl solution of pH 6.0.

The protein concentration of purified bispecific constructs was determined by measuring the OD at 280 nm, using the molar extinction coefficient calculated on the basis of the amino acid sequence. Purity and molecular weight of the bispecific constructs were analyzed by CE-SDS in the presence and absence of a reducing agent (Invitrogen, USA) using a LabChipGXII (Caliper). The aggregate content of bispecific constructs was analyzed using a TSKgel G3000 SW XL analytical size-exclusion column (Tosoh) equilibrated in a 25 mM $K_2HPO_4$, 125 mM NaCl, 200 mM L-Arginine Monohydrocloride, 0.02% (w/v) $NaN_3$, pH 6.7 running buffer at 25° C.

Table 28 summarizes the biochemical analysis of bispecific, monovalent anti-Ox40/anti-FAP IgG1 P329G LALA kih antigen binding molecules.

TABLE 28

Biochemical analysis of bispecific monovalent anti-Ox40/anti-FAP IgG1 P329G LALA kih antigen binding molecules

| Clone | Yield [mg/l] | Monomer [%] | CE-SDS (non red) | CE-SDS (red) |
|---|---|---|---|---|
| 8H9/FAP P329GLALA IgG1 1 + 1 | 16.5 | 100 | 92.1% (164 kDa) 1.9% (145 kDa) 3.6% (120.1 kDa) | 67.7% (63.6 kDa) 13.3% (28.5 kDa) 16.5% (25.7 kDa) |
| 1G4/FAP P329GLALA IgG1 1 + 1 | 12.5 | 98.5 | 85.2% (157 kDa) 7.4% (151 kDa) 2.8% (139.5 kDa) | 69.5% (64.2 kDa) 13.1% (28.8 kDa) 16.7% (26.2 kDa) |
| 49B4/FAP P329GLALA IgG1 1 + 1 | 2.3 | 97.9 | 80% (153 kDa) 11.9% (141 kDa) 4.3% (120 kDa) | 70.4% (63.5 kDa) 14.7% (28 kDa) 13.7% (25 kDa) |
| 20B7/FAP P329GLALA IgG1 1 + 1 | 22 | 100 | 97.5% (166 kDa) 1.3% (149 kDa) | 82.7% (56.2 kDa) 8.2% (27.2 kDa) 8.1% (24.3 kDa) |

4.3 Characterization of Bispecific Constructs Targeting Ox40 and FAP 4.3.1 Surface Plasmon Resonance (Simultaneous Binding)

The capacity of binding simultaneously human Ox40 Fc(kih) and human FAP was assessed by surface plasmon resonance (SPR). All SPR experiments were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany). Biotinylated human Ox40 Fc(kih) was directly coupled to a flow cell of a streptavidin (SA) sensor chip. Immobilization levels up to 1000 resonance units (RU) were used.

The bispecific constructs targeting Ox40 and FAP were passed at a concentration range of 250 nM with a flow of 30 µL/minute through the flow cells over 90 seconds and dissociation was set to zero sec. Human FAP was injected as second analyte with a flow of 30 µL/minute through the flow cells over 90 seconds at a concentration of 250 nM (FIG.

12C). The dissociation was monitored for 120 sec. Bulk refractive index differences were corrected for by subtracting the response obtained in a reference flow cell, where no protein was immobilized.

As can be seen in the graphs of FIGS. 13A-13H, all bispecific constructs could bind simultaneously human Ox40 and human FAP.

4.3.2 Binding on Cells 4.3.2.1 Binding to Naïve Versus Activated Human PBMCs of FAP-targeted Anti-Ox40 Antibodies Human PBMC were isolated by ficoll density gradient centrifugation as described in Example 2.1.2. PBMCs were used directly after isolation (binding on resting human PBMCs) or they were stimulated to receive a strong human Ox40 expression on the cell surface of T cells (binding on activated human PBMCs). Therefore naïve PBMCs were cultured for four to seven days in T cell medium supplied with 200 U/mL Proleukin and 2 ug/mL PHA-L in 6-well tissue culture plate and then 1 day on pre-coated 6-well tissue culture plates [10 ug/mL anti-human CD3 (clone OKT3) and 2 ug/mL anti-human CD28 (clone CD28.2)] in T cell medium supplied with 200 U/mL Proleukin at 37° C. and 5% $CO_2$.

For detection of Ox40 naïve human PBMC and activated human PBMC were mixed. To enable distinction of naïve from activated human PBMC naïve cells were labeled prior to the binding assay using the eFluor670 cell proliferation dye (eBioscience, Cat.-No. 65-0840-85). A 1 to 1 mixture of $1 \times 10^5$ naïve, eFluor670 labeled human PBMC and unlabeled activated human PBMC were then added to each well of a round-bottom suspension cell 96-well plates (greiner bio-one, cellstar, Cat. No. 650185) and the binding assay was performed as described in Example 2.1.2. A 1 to 1 mixture of $1 \times 10^5$ naïve, eFluor670 labeled human PBMC and unlabeled activated human PBMC were then added to each well of a round-bottom suspension cell 96-well plates (greiner bio-one, cellstar, Cat. No. 650185) and binding assay was performed as described in section 2.1.2.

Primary antibodies were titrated anti-Ox40 antibody constructs, incubated for 120 minutes at 4° C. Secondary antibody solution was a mixture of fluorescently labeled anti-human CD4 (clone RPA-T4, mouse IgG1 k, BioLegend, Cat.-No. 300532), anti-human CD8 (clone RPa-T8, mouse IgG1k, BioLegend, Cat.-No. 3010441) and Fluorescein isothiocyanate (FITC)-conjugated AffiniPure anti-human IgG Fcγ-fragment-specific goat IgG F(ab')$_2$ fragment (Jackson ImmunoResearch, Cat.-No. 109-096-098), incubated for 30 minutes at 4° C. in the dark. Plates were finally resuspended in 80 μL/well FACS-buffer containing 0.2 μg/mL DAPI (Santa Cruz Biotec, Cat. No. Sc-3598) and acquired the same day using 5-laser LSR-Fortessa (BD Bioscience with DIVA software).

Figure 14J:
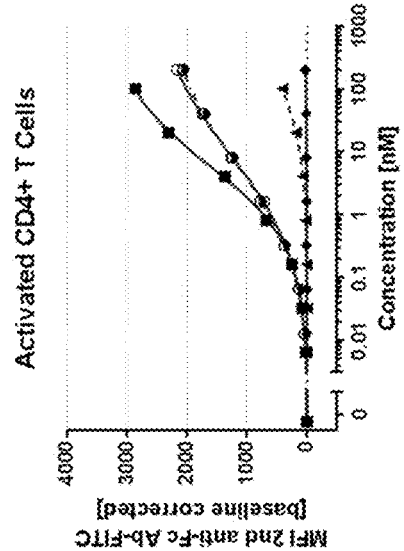
FIGS. 14J, 14K, 14L and 14M show that the bivalent FAP-targeted OX40 constructs showed stronger binding characteristics to OX40 positive cells as respective clone in a monovalent antibody format.
Figure 14L:
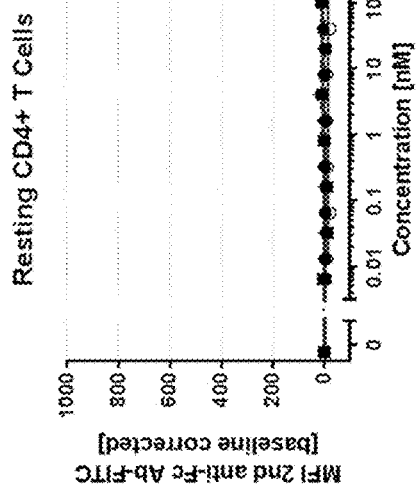
Figure 14K:
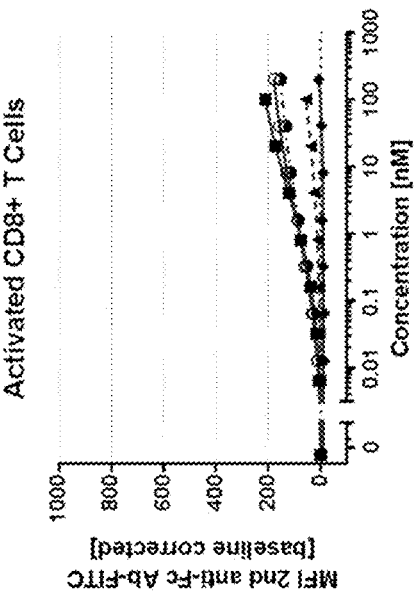
Figure 14M:
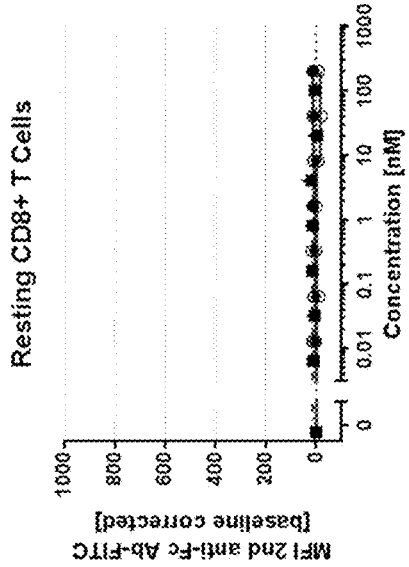
Figure 14N:
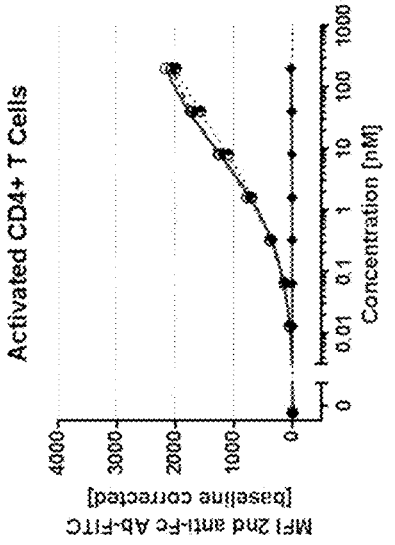
FIGS. 14N, 14O, 14P and 14Q show that different 2+1 constructs bound with similar strength to OX40 positive T cells, independently of the second binding moiety.
Figure 14O:
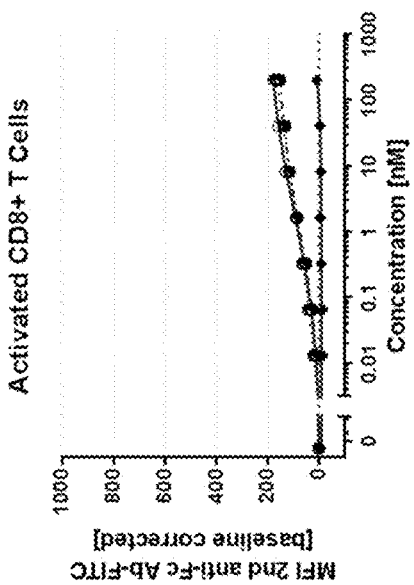
Figure 14P:
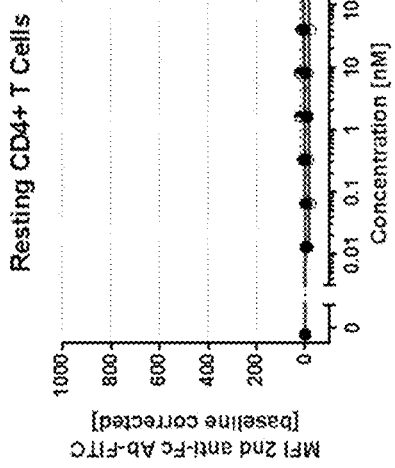
Figure 14Q:
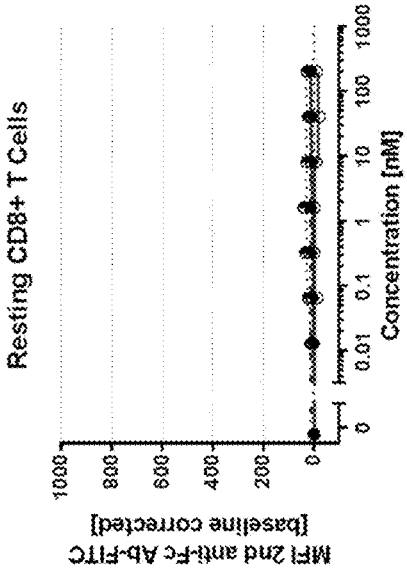

As shown in FIGS. 14A-14Q, no antigen binding molecule specific for Ox40 bound to resting human CD4$^+$ T-cells or CD8$^+$ T-cells. In contrast, all antigen binding molecules bound to activated CD8$^+$ or CD4$^+$ T-cells. Binding to CD4$^+$ T-cells was much stronger than that to CD8$^+$ T cells similar to what was described already in Example 2.1.2. As shown in FIGS. 14A-14Q, bivalent FAP targeted Ox40 construct showed similar binding characteristics to Ox40 positive and negative cells as respective clones in a conventional IgG antibody format, whereas monovalent antibodies had a clearly reduced capacity to bind to Ox40 positive cells due to the loss of avidity.

4.3.2.2 Binding to Human FAP-expressing Tumor Cells

The binding to cell surface FAP was tested using human fibroblast activating protein (huFAP) expressing cells NIH/3T3-huFAP clone 39 or WM266-4 cells (ATCC CRL-1676). NIH/3T3-huFAP clone 39 was generated by the transfection of the mouse embryonic fibroblast NIH/3T3 cell line (ATCC CRL-1658) with the expression vector pETR4921 to express huFAP under 1.5 μg/mL Puromycin selection. In some assays WM266-4 cells were pre-labeled with PKH-26 Red Fluorescence Cell linker Kit (Sigma, Cat.-No. PKH26GL) as described in Example 2.3.2 to allow separation of these tumor cells from other cells present (e.g. human PBMC).

$0.5 \times 10^5$ NIH/3T3-huFAP clone 39 or WM266-4 cells were then added to each well of a round-bottom suspension cell 96-well plates (greiner bio-one, cellstar, Cat. No. 650185) and the binding assay was performed in a similar manner as described in Example 2.3.2. Plates were centrifuged 4 minutes, 400×g at 4° C. and supernatants were flicked off. Cells were washed once with 200 μL DPBS and pellets were resuspended by a short and gentle vortex. All samples were resuspended in 50 μL/well of 4° C. cold FACS buffer containing the bispecific antigen binding molecules (primary antibody) at the indicated range of concentrations (titrated) and incubated for 120 minutes at 4° C. Afterwards the cells were washed four times with 200 μL 4° C. FACS buffer and resuspended by a short vortex. Cells were further stained with 25 μL/well of 4° C. cold secondary antibody solution containing Fluorescein isothiocyanate (FITC)-conjugated AffiniPure anti-human IgG Fcγ-fragment-specific goat IgG F(ab')$_2$ fragment (Jackson ImmunoResearch, Cat. No. 109-096-098) and incubated for 30 minutes at 4° C. in the dark. Plates were finally resuspended in 80 μL/well FACS-buffer containing 0.2 μg/mL DAPI (Santa Cruz Biotec, Cat. No. Sc-3598) and acquired the same day using 5-laser LSR-Fortessa (BD Bioscience with DIVA software).

As shown in FIGS. 15A and 15B, the FAP-targeted mono- and bivalent anti-Ox40 antigen binding molecules but not the same clones in the huIgG1 P329GLALA format efficiently bound to human FAP-expressing target cells. Therefore only FAP-targeted mono- and bivalent anti-Ox40 antigen binding molecules show direct tumor-targeting properties. The bivalent construct (filled square) showed stronger binding to FAP than the monovalent constructs explained by a gain of avidity in the bivalent relative to the monovalent format. This was more prominent in the high FAP expressing NIH/3T3-huFAP clone 39 cells (FIG. 15A) than in the lower FAP expressing WM266-4 cells (FIG. 15B). A lower density of surface FAP on WM266-4 cells might not provide the close proximity of FAP molecules to always allow bivalent binding of the anti-OX40 constructs. $EC_{50}$ values of binding to activated human CD4 T cells and FAP positive tumor cells are summarized in Table 29.

TABLE 29

EC50 values for binding of selected aOx40 binder (clone 8H9, 1G4) in a FAP targeted mono or bivalent format to cell surface human FAP and human Ox40

| Clone | Format | FAP$^+$ cell $EC_{50}$ [nM] | OX40$^+$ cell $EC_{50}$ [nM] |
|---|---|---|---|
| 8H9 | hu IgG1 | n.a. | 0.59 |
| (WM266-4) | FAP 1 + 1 | 5.99 | 8.20 |
| | FAP 2 + 2 | 2.88 | 0.93 |
| 1G4 | hu IgG1 | n.a. | n.a. |
| (NIH/3T3 huFAP | FAP 1 + 1 | 3.55 | 49.07 |
| clone 39) | FAP 2 + 2 | 0.77 | 9.37 |

4.4 Generation of Bispecific Antigen Binding Molecules Targeting OX40 and Fibroblast Activation Protein (FAP) that are Bivalent for OX40 and Monovalent for FAP (2+1 Format)

Bispecific agonistic Ox40 antibodies with bivalent binding for Ox40 and monovalent binding for FAP were prepared by applying the knob-into-hole technology to allow the assembling of two different heavy chains.

In this example, the first heavy chain (HC 1) was comprised of one Fab unit (VHCH1) of the anti-OX40 binder 49B4 followed by Fc knob chain fused by a (G$_4$S) linker to a VH domain of the anti-FAP binder 28H1 or 4B9. The second heavy chain (HC 2) of the construct was comprised of one Fab units (VHCH1) of the anti-OX40 binder 49B4 followed Fc hole chain fused by a (G$_4$S) linker to a VL domain of the anti-FAP binder 28H1 or 4B9.

The generation and preparation of the FAP binders is described in WO 2012/020006 A2, which is incorporated herein by reference.

Figure 12D:
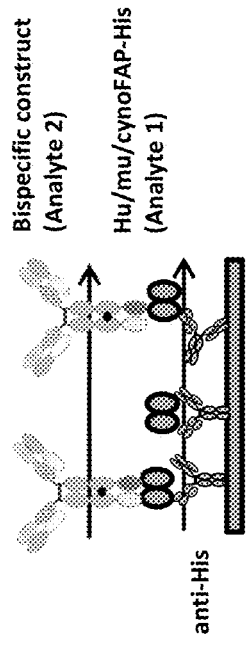
FIG. 12D shows a schematic drawing of an exemplary bispecific antigen binding molecule, that is bivalent for binding to OX40 and monovalent for binding to FAP. It comprises two Fab fragments binding to OX40 and a VH and VL domain binding to FAP. The black point symbolizes the knob into hole modifications in the heavy chains.

The Pro329Gly, Leu234Ala and Leu235Ala mutations were introduced in the constant region of the heavy chains to abrogate binding to Fc gamma receptors according to the method described in International Patent Appl. Publ. No. WO 2012/130831 A1. The heavy chain fusion proteins were co-expressed with the light chain of the anti-OX40 binder 49B4 (CLVL). The resulting bispecific, construct bivalent for binding to OX40 is depicted in FIG. 12D and the nucleotide and amino acid sequences can be found in Table 30.

In addition, an "untargeted" 2+1 construct was prepared, wherein the VH and VL domain of the anti-FAP binder were replaced by a germline control, termed DP47, not binding to the antigen.

TABLE 30 cDNA and amino acid sequences of mature bispecific bivalent
anti-Ox40/monovalent anti-FAP huIgG1 P329GLALA kih antibodies
(2 + 1 format) and untargeted (DP47) 2 + 1 construct

| SEQ ID NO: | Description | Sequence |
|---|---|---|
| 184 | (49B4) VLCL-light chain (nucleotide sequence) | see Table 13 |
| 304 | (49B4) VHCH1 Fc knob VH (4B9) (nucleotide sequence of heavy chain 1) | CAGGTGCAATTGGTGCAGTCTGGGGCTGAGGTGAAGA<br>AGCCTGGGTCCTCGGTGAAGGTCTCCTGCAAGGCCTCC<br>GGAGGCACATTCAGCAGCTACGCTATAAGCTGGGTGC<br>GACAGGCCCCTGGACAAGGGCTCGAGTGGATGGGAGG<br>GATCATCCCTATCTTTGGTACAGCAAACTACGCACAGA<br>AGTTCCAGGGCAGGGTCACCATTACTGCAGACAAATCC<br>ACGAGCACAGCCTACATGGAGCTGAGCAGCCTGAGAT<br>CTGAGGACACCGCCGTGTATTACTGTGCGAGAGAATAC<br>TACCGTGGTCCGTACGACTACTGGGGCCAAGGGACCA<br>CCGTGACCGTCTCCTCAGCTAGCACCAAGGGCCCATCG<br>GTCTTCCCCCTGGCACCCTCCTCCAAGAGCACCTCTGG<br>GGGCACAGCGGCCCTGGGCTGCCTGGTCAAGGACTAC<br>TTCCCCGAACCGGTGACGGTGTCGTGGAACTCAGGCGC<br>CCTGACCAGCGGCGTGCACACCTTCCCGGCTGTCCTAC<br>AGTCCTCAGGACTCTACTCCCTCAGCAGCGTGGTGACC<br>GTGCCCTCCAGCAGCTTGGGCACCCAGACCTACATCTG<br>CAACGTGAATCACAAGCCCAGCAACACCAAGGTGGAC<br>AAGAAAGTTGAGCCCAAATCTTGTGACAAAACTCACA<br>CATGCCCACCGTGCCCAGCACCTGAAGCTGCAGGGGG<br>ACCGTCAGTCTTCCTCTTCCCCCCAAAACCCAAGGACA<br>CCCTCATGATCTCCCGGACCCCTGAGGTCACATGCGTG<br>GTGGTGGACGTGAGCCACGAAGACCCTGAGGTCAAGT<br>TCAACTGGTACGTGGACGGCGTGGAGGTGCATAATGC<br>CAAGACAAAGCCGCGGGAGGAGCAGTACAACAGCACG<br>TACCGTGTGGTCAGCGTCCTCACCGTCCTGCACCAGGA<br>CTGGCTGAATGGCAAGGAGTACAAGTGCAAGGTCTCC<br>AACAAAGCCCTCGGCGCCCCCATCGAGAAAACCATCT<br>CCAAAGCCAAAGGGCAGCCCCGAGAACCACAGGTGTA<br>CACCCTGCCCCCCTGCAGAGATGAGCTGACCAAGAAC<br>CAGGTGTCCCTGTGGTGTCTGGTCAAGGGCTTCTACCC<br>CAGCGATATCGCCGTGGAGTGGGAGAGCAACGGCCAG<br>CCTGAGAACAACTACAAGACCACCCCCCCTGTGCTGGA<br>CAGCGACGGCAGCTTCTTCCTGTACTCCAAACTGACCG<br>TGGACAAGAGCCGGTGGCAGCAGGGCAACGTGTTCAG<br>CTGCAGCGTGATGCACGAGGCCCTGCACAACCACTAC<br>ACCCAGAAGTCCCTGAGCCTGAGCCCCGGCGGAGGCG<br>GCGGAAGCGGAGGAGGAGGATCTGGGGGCGGAGGTTC<br>CGGAGGCGGAGGATCCGAGGTGCAGCTGCTCGAAAGC<br>GGCGGAGGACTGGTGCAGCCTGGCGGCAGCCTGAGAC<br>TGTCTTGCGCCGCCAGCGGCTTCACCTTCAGCAGCTAC<br>GCCATGAGCTGGGTCCGCCAGGCCCCTGGCAAGGGAC<br>TGGAATGGGTGTCCGCCATCATCGGCTCTGGCGCCAGC<br>ACCTACTACGCCGACAGCGTGAAGGGCCGGTTCACCAT<br>CAGCCGGGACAACAGCAAGAACACCCTGTACCTGCAG<br>ATGAACAGCCTGCGGGCCGAGGACACCGCCGTGTACT<br>ACTGCGCCAAGGGATGGTTCGGCGGCTTCAACTACTGG<br>GGACAGGGCACCCTGGTCACCGTGTCCAGC |

TABLE 30-continued cDNA and amino acid sequences of mature bispecific bivalent
anti-Ox40/monovalent anti-FAP huIgG1 P329GLALA kih antibodies
(2 + 1 format) and untargeted (DP47) 2 + 1 construct

| SEQ ID NO: | Description | Sequence |
|---|---|---|
| 305 | (49B4) VHCH1 Fc hole VL (4B9) (nucleotide sequence of heavy chain 2) | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTCGAGTGGATGGGAGG GATCATCCCTATCTTTGGTACAGCAAACTACGCACAGA AGTTCCAGGGCAGGGTCACCATTACTGCAGACAAATCC ACGAGCACAGCCTACATGGAGCTGAGCAGCCTGAGAT CTGAGGACACCGCCGTGTATTACTGTGCGAGAGAATAC TACCGTGGTCCGTACGACTACTGGGGCCAAGGGACCA CCGTGACCGTCTCCTCAGCTAGCACCAAGGGCCCATCG GTCTTCCCCCTGGCACCCTCCTCCAAGAGCACCTCTGG GGGCACAGCGGCCCTGGGCTGCCTGGTCAAGGACTAC TTCCCCGAACCGGTGACGGTGTCGTGGAACTCAGGCGC CCTGACCAGCGGCGTGCACACCTTCCCGGCTGTCCTAC AGTCCTCAGGACTCTACTCCCTCAGCAGCGTGGTGACC GTGCCCTCCAGCAGCTTGGGCACCCAGACCTACATCTG CAACGTGAATCACAAGCCCAGCAACACCAAGGTGGAC AAGAAAGTTGAGCCCAAATCTTGTGACAAAACTCACA CATGCCCACCGTGCCCAGCACCTGAAGCTGCAGGGGG ACCGTCAGTCTTCCTCTTCCCCCCAAAACCCAAGGACA CCCTCATGATCTCCCGGACCCCTGAGGTCACATGCGTG GTGGTGGACGTGAGCCACGAAGACCCTGAGGTCAAGT TCAACTGGTACGTGGACGGCGTGGAGGTGCATAATGC CAAGACAAAGCCGCGGGAGGAGCAGTACAACAGCACG TACCGTGTGGTCAGCGTCCTCACCGTCCTGCACCAGGA CTGGCTGAATGGCAAGGAGTACAAGTGCAAGGTCTCC AACAAAGCCCTCGGCGCCCCCATCGAGAAAACCATCT CCAAAGCCAAAGGGCAGCCCCGAGAACCACAGGTGTG CACCCTGCCCCCATCCCGGGATGAGCTGACCAAGAACC AGGTCAGCCTCTCGTGCGCAGTCAAAGGCTTCTATCCC AGCGACATCGCCGTGGAGTGGGAGAGCAATGGGCAGC CGGAGAACAACTACAAGACCACGCCTCCCGTGCTGGA CTCCGACGGCTCCTTCTTCCTCGTGAGCAAGCTCACCG TGGACAAGAGCAGGTGGCAGCAGGGGAACGTCTTCTC ATGCTCCGTGATGCATGAGGCTCTGCACAACCACTACA CGCAGAAGAGCCTCTCCCTGTCTCCGGGTGGAGGCGGC GGAAGCGGAGGAGGAGGATCCGGCGGCGGAGGTTCCG GAGGCGGTGGATCTGAGATCGTGCTGACCCAGTCTCCC GGCACCCTGTCTCTGAGCCCTGGCGAGAGAGCCACCCT GTCCTGCAGAGCCTCCCAGTCCGTGACCTCCTCCTACC TCGCCTGGTATCAGCAGAAGCCCGGCCAGGCCCCTCGG CTGCTGATCAACGTGGGCAGTCGGAGAGCCACCGGCA TCCCTGACCGGTTCTCCGGCTCTGGCTCCGGCACCGAC TTCACCCTGACCATCTCCCGGCTGGAACCCGAGGACTT CGCCGTGTACTACTGCCAGCAGGGCATCATGCTGCCCC CACCCTTTGGCCAGGGCACCAAGGTGGAAATCAAG |
| 186 | (49B4) VLCL-light chain | see Table 13 |
| 306 | (49B4) VHCH1 Fc knob VH (4B9) (heavy chain 1) | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCAREYYRGPYDYWGQGTTVTVS SASTKGPSVFPLAPSSKSTSGGTAALGCLVKDYFPEPVTV SWNSGALTSGVHTFPAVLQSSGLYSLSSVVTVPSSSLGTQ TYICNVNHKPSNTKVDKKVEPKSCDKTHTCPPCPAPEAA GGPSVFLFPPKPKDTLMISRTPEVTCVVVDVSHEDPEVKF NWYVDGVEVHNAKTKPREEQYNSTYRVVSVLTVLHQD WLNGKEYKCKVSNKALGAPIEKTISKAKGQPREPQVYTL PPCRDELTKNQVSLWCLVKGFYPSDIAVEWESNGQPENN YKTTPPVLDSDGSFFLYSKLTVDKSRWQQGNVFSCSVMH EALHNHYTQKSLSLSPGGGGSGGGGSGGGGSGGGGSE VQLLESGGGLVQPGGSLRLSCAASGFTFSSYAMSWVRQA PGKGLEWVSAIIGSGASTYYADSVKGRFTISRDNSKNTLY LQMNSLRAEDTAVYYCAKGWFGGFNYWGQGTLVTVSS |
| 307 | (49B4) VHCH1 Fc hole VL (4B9) (heavy chain 2) | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCAREYYRGPYDYWGQGTTVTVS SASTKGPSVFPLAPSSKSTSGGTAALGCLVKDYFPEPVTV SWNSGALTSGVHTFPAVLQSSGLYSLSSVVTVPSSSLGTQ TYICNVNHKPSNTKVDKKVEPKSCDKTHTCPPCPAPEAA |

TABLE 30-continued cDNA and amino acid sequences of mature bispecific bivalent
anti-Ox40/monovalent anti-FAP huIgG1 P329GLALA kih antibodies
(2 + 1 format) and untargeted (DP47) 2 + 1 construct

| SEQ ID NO: | Description | Sequence |
|---|---|---|
| | | GGPSVFLFPPKPKDTLMISRTPEVTCVVVDVSHEDPEVKF NWYVDGVEVHNAKTKPREEQYNSTYRVVSVLTVLHQD WLNGKEYKCKVSNKALGAPIEKTISKAKGQPREPQVCTL PPSRDELTKNQVSLSCAVKGFYPSDIAVEWESNGQPENN YKTTPPVLDSDGSFFLVSKLTVDKSRWQQGNVFSCSVMH EALHNHYTQKSLSLSPGGGGSGGGGSGGGGSGGGGSEI VLTQSPGTLSLSPGERATLSCRASQSVTSSYLAWYQQKPG QAPRLLINVGSRRATGIPDRFSGSGSGTDFTLTISRLEPEDF AVYYCQQGIMLPPTFGQGTKVEIK |
| 184 | (49B4) VLCL-light chain (nucleotide sequence) | see Table 13 |
| 308 | (49B4) VHCH1 Fc knob VH (28H1) (nucleotide sequence, heavy chain 1) | CAGGTGCAATTGGTGCAGTCTGGGGCTGAGGTGA AGAAGCCTGGGTCCTCGGTGAAGGTCTCCTGCAA GGCCTCCGGAGGCACATTCAGCAGCTACGCTATA AGCTGGGTGCGACAGGCCCCTGGACAAGGGCTG AGTGGATGGGAGGGATCATCCCTATCTTTGGTACA GCAAACTACGCACAGAAGTTCCAGGGCAGGGTCA CCATTACTGCAGACAAATCCACGAGCACAGCCTA CATGGAGCTGAGCAGCCTGAGATCTGAGGACACC GCCGTGTATTACTGTGCGAGAGAATACTACCGTGG TCCGTACGACTACTGGGGCCAAGGGACCACCGTG ACCGTCTCCTCAGCTAGCACCAAGGGCCCATCGGT CTTCCCCCTGGCACCCTCCTCCAAGAGCACCTCTG GGGGCACAGCGGCCCTGGGCTGCCTGGTCAAGGA CTACTTCCCCGAACCGGTGACGGTGTCGTGGAACT CAGGCGCCCTGACCAGCGGCGTGCACACCTTCCC GGCTGTCCTACAGTCCTCAGGACTCTACTCCCTCA GCAGCGTGGTGACCGTGCCCTCCAGCAGCTTGGG CACCCAGACCTACATCTGCAACGTGAATCACAAG CCCAGCAACACCAAGGTGGACAAGAAAGTTGAGC CCAAATCTTGTGACAAAACTCACACATGCCCACCG TGCCCAGCACCTGAAGCTGCAGGGGGACCGTCAG TCTTCCTCTTCCCCCCAAAACCCAAGGACACCCTC ATGATCTCCCGGACCCCTGAGGTCACATGCGTGGT GGTGGACGTGAGCCACGAAGACCCTGAGGTCAAG TTCAACTGGTACGTGGACGGCGTGGAGGTGCATA ATGCCAAGACAAAGCCGCGGGAGGAGCAGTACAA CAGCACGTACCGTGTGGTCAGCGTCCTCACCGTCC TGCACCAGGACTGGCTGAATGGCAAGGAGTACAA GTGCAAGGTCTCCAACAAAGCCCTCGGCGCCCCC ATCGAGAAAACCATCTCCAAAGCCAAAGGGCAGC CCCGAGAACCACAGGTGTACACCCTGCCCCCCTGC AGAGATGAGCTGACCAAGAACCAGGTGTCCCTGT GGTGTCTGGTCAAGGGCTTCTACCCCAGCGATATC GCCGTGGAGTGGGAGAGCAACGGCCAGCCTGAGA CAACTACAAGACCACCCCCCCTGTGCTGGACAG CGACGGCAGCTTCTTCCTGTACTCCAAACTGACCG TGGACAAGAGCCGGTGGCAGCAGGGCAACGTGTT CAGCTGCAGCGTGATGCACGAGGCCCTGCACAAC CACTACACCCAGAAGTCCCTGAGCCTGAGCCCCG GCGGAGGCGGCGAAGCGGAGGAGGAGGATCCG GAGGAGGGGGAAGTGGCGGCGGAGGATCTGAGG TGCAGCTGCTGGAATCCGGCGGAGGCCTGGTGCA GCCTGGCGGATCTCTGAGACTGTCCTGCGCCGCCT CCGGCTTCACCTTCTCCTCCCACGCCATGTCCTGG GTCCGACAGGCTCCTGGCAAAGGCCTGGAATGGG TGTCCGCCATCTGGGCCTCCGGCGAGCAGTACTAC GCCGACTCTGTGAAGGGCCGGTTCACCATCTCCCG GGACAACTCCAAGAACACCCTGTACCTGCAGATG AACTCCCTGCGGGCCGAGGACACCGCCGTGTACT ACTGTGCCAAGGGCTGGCTGGGCAACTTCGACTA CTGGGGCCAGGGCACCCTGGTCACCGTGTCCAGC |
| 309 | (49B4) VHCH1 Fc hole VL (28H1) (nucleotide sequence, heavy chain 2) | CAGGTGCAATTGGTGCAGTCTGGGGCTGAGGTGA AGAAGCCTGGGTCCTCGGTGAAGGTCTCCTGCAA GGCCTCCGGAGGCACATTCAGCAGCTACGCTATA AGCTGGGTGCGACAGGCCCCTGGACAAGGGCTCG AGTGGATGGGAGGGATCATCCCTATCTTTGGTACA GCAAACTACGCACAGAAGTTCCAGGGCAGGGTCA CCATTACTGCAGACAAATCCACGAGCACAGCCTA |

TABLE 30-continued cDNA and amino acid sequences of mature bispecific bivalent
anti-Ox40/monovalent anti-FAP huIgG1 P329GLALA kih antibodies
(2 + 1 format) and untargeted (DP47) 2 + 1 construct

| SEQ ID NO: | Description | Sequence |
|---|---|---|
| | | CATGGAGCTGAGCAGCCTGAGATCTGAGGACACC GCCGTGTATTACTGTGCGAGAGAATACTACCGTGG TCCGTACGACTACTGGGGCCAAGGGACCACCGTG ACCGTCTCCTCAGCTAGCACCAAGGGCCCATCGGT CTTCCCCCTGGCACCCTCCTCCAAGAGCACCTCTG GGGGCACAGCGGCCCTGGGCTGCCTGGTCAAGGA CTACTTCCCCGAACCGGTGACGGTGTCGTGGAACT CAGGCGCCCTGACCAGCGGCGTGCACACCTTCCC GGCTGTCCTACAGTCCTCAGGACTCTACTCCCTCA GCAGCGTGGTGACCGTGCCCTCCAGCAGCTTGGG CACCCAGACCTACATCTGCAACGTGAATCACAAG CCCAGCAACACCAAGGTGGACAAGAAAGTTGAGC CCAAATCTTGTGACAAAACTCACACATGCCCACCG TGCCCAGCACCTGAAGCTGCAGGGGGACCGTCAG TCTTCCTCTTCCCCCCAAAACCCAAGGACACCCTC ATGATCTCCCGGACCCCTGAGGTCACATGCGTGGT GGTGGACGTGAGCCACGAAGACCCTGAGGTCAAG TTCAACTGGTACGTGGACGGCGTGGAGGTGCATA ATGCCAAGACAAAGCCGCGGGAGGAGCAGTACAA CAGCACGTACCGTGTGGTCAGCGTCCTCACCGTCC TGCACCAGGACTGGCTGAATGGCAAGGAGTACAA GTGCAAGGTCTCCAACAAAGCCCTCGGCGCCCCC ATCGAGAAAACCATCTCCAAAGCCAAAGGGCAGC CCCGAGAACCACAGGTGTGCACCCTGCCCCCATCC CGGGATGAGCTGACCAAGAACCAGGTCAGCCTCT CGTGCGCAGTCAAAGGCTTCTATCCCAGCGACATC GCCGTGGAGTGGGAGAGCAATGGGCAGCCGGAGA ACAACTACAAGACCACGCCTCCCGTGCTGGACTCC GACGGCTCCTTCTTCCTCGTGAGCAAGCTCACCGT GGACAAGAGCAGGTGGCAGCAGGGGAACGTCTTC TCATGCTCCGTGATGCATGAGGCTCTGCACAACCA CTACACGCAGAAGAGCCTCTCCCTGTCTCCGGGTG GAGGCGGCGGAAGCGGAGGAGGAGGATCCGGTG GTGGCGGATCTGGGGGCGGTGGATCTGAGATCGT GCTGACCCAGTCTCCCGGCACCCTGAGCCTGAGCC CTGGCGAGAGAGCCACCCTGAGCTGCAGAGCCAG CCAGAGCGTGAGCCGGAGCTACCTGGCCTGGTAT CAGCAGAAGCCCGGCCAGGCCCCCAGACTGCTGA TCATCGGCGCCAGCACCCGGGCCACCGGCATCCC CGATAGATTCAGCGGCAGCGGCTCCGGCACCGAC TTCACCCTGACCATCAGCCGGCTGGAACCCGAGG ACTTCGCCGTGTACTACTGCCAGCAGGGCCAGGTG ATCCCCCCCACCTTCGGCCAGGGCACCAAGGTGG AAATCAAG |
| 186 | (49B4) VLCL-light chain | see Table 13 |
| 310 | (49B4) VHCH1 Fc knob VH (28H1) (heavy chain 1) | QVQLVQSGAEVKKPGSSVKVSCKASGGTFSSYAISW VRQAPGQGLEWMGGIIPIFGTANYAQKFQGRVTITA DKSTSTAYMELSSLRSEDTAVYYCAREYYRGPYDY WGQGTTVTVSSASTKGPSVFPLAPSSKSTSGGTAAL GCLVKDYFPEPVTVSWNSGALTSGVHTFPAVLQSSG LYSLSSVVTVPSSSLGTQTYICNVNHKPSNTKVDKK VEPKSCDKTHTCPPCPAPEAAGGPSVFLFPPKPKDTL MISRTPEVTCVVVDVSHEDPEVKFNWYVDGVEVHN AKTKPREEQYNSTYRVVSVLTVLHQDWLNGKEYKC KVSNKALGAPIEKTISKAKGQPREPQVYTLPPCRDEL TKNQVSLWCLVKGFYPSDIAVEWESNGQPENNYKT TPPVLDSDGSFFLYSKLTVDKSRWQQGNVFSCSVMH EALHNHYTQKSLSLSPGGGGSGGGGSGGGGSGGG GSEVQLLESGGGLVQPGGSLRLSCAASGFTFSSHAM SWVRQAPGKGLEWVSAIWASGEQYYADSVKGRFTI SRDNSKNTLYLQMNSLRAEDTAVYYCAKGWLGNF DYWGQGTLVTVSS |
| 311 | (49B4) VHCH1 Fc hole VL (28H1) (heavy chain 2) | QVQLVQSGAEVKKPGSSVKVSCKASGGTFSSYAISWV RQAPGQGLEWMGGIIPIFGTANYAQKFQGRVTITADK STSTAYMELSSLRSEDTAVYYCAREYYRGPYDYWQG TTVTVSSASTKGPSVFPLAPSSKSTSGGTAALGCLVKDY FPEPVTVSWNSGALTSGVHTFPAVLQSSGLYSLSSVVT VPSSSLGTQTYICNVNHKPSNTKVDKKVEPKSCDKTH TCPPCPAPEAAGGPSVFLFPPKPKDTLMISRTPEVTCV |

TABLE 30-continued cDNA and amino acid sequences of mature bispecific bivalent
anti-Ox40/monovalent anti-FAP huIgG1 P329GLALA kih antibodies
(2 + 1 format) and untargeted (DP47) 2 + 1 construct

| SEQ ID NO: | Description | Sequence |
|---|---|---|
| | | VVDVSHEDPEVKFNWYVDGVEVHNAKTKPREEQYN STYRVVSVLTVLHQDWLNGKEYKCKVSNKALGAPIEK TISKAKGQPREPQVCTLPPSRDELTKNQVSLSCAVKGF YPSDIAVEWESNGQPENNYKTTPPVLDSDGSFFLVSKL TVDKSRWQQGNVFSCSVMHEALHNHYTQKSLSLSPG GGGGSGGGGSGGGGSGGGGSEIVLTQSPGTLSLSPGER ATLSCRASQSVSRSYLAWYQQKPGQAPRLLIIGASTRA TGIPDRFSGSGSGTDFTLTISRLEPEDFAVYYCQQGQVI PPTFGQGTKVEIK |
| 184 | (49B4) VLCL-light chain (nucleotide sequence) | see Table 13 |
| 312 | (49B4) VHCH1 Fc knob VH (DP47) (nucleotide sequence, heavy chain 1) | CAGGTGCAATTGGTGCAGTCTGGGGCTGAGGTGA AGAAGCCTGGGTCCTCGGTGAAGGTCTCCTGCAA GGCCTCCGGAGGCACATTCAGCAGCTACGCTATA AGCTGGGTGCGACAGGCCCCTGGACAAGGGCTCG AGTGGATGGGAGGGATCATCCCTATCTTTGGTACA GCAAACTACGCACAGAAGTTCCAGGGCAGGGTCA CCATTACTGCAGACAAATCCACGAGCACAGCCTA CATGGAGCTGAGCAGCCTGAGATCTGAGGACACC GCCGTGTATTACTGTGCGAGAGAATACTACCGTGG TCCGTACGACTACTGGGGCCAAGGGACCACCGTG ACCGTCTCCTCAGCTAGCACCAAGGGCCCATCGGT CTTCCCCCTGGCACCCTCCTCCAAGAGCACCTCTG GGGGCACAGCGGCCCTGGGCTGCCTGGTCAAGGA CTACTTCCCCGAACCGGTGACGGTGTCGTGGAACT CAGGCGCCCTGACCAGCGGCGTGCACACCTTCCC GGCTGTCCTACAGTCCTCAGGACTCTACTCCCTCA GCAGCGTGGTGACCGTGCCCTCCAGCAGCTTGGG CACCCAGACCTACATCTGCAACGTGAATCACAAG CCCAGCAACACCAAGGTGGACAAGAAAGTTGAGC CCAAATCTTGTGACAAAACTCACACATGCCCACCG TGCCCAGCACCTGAAGCTGCAGGGGGACCGTCAG TCTTCCTCTTCCCCCCAAAACCCAAGGACACCCTC ATGATCTCCCGGACCCCTGAGGTCACATGCGTGGT GGTGGACGTGAGCCACGAAGACCCTGAGGTCAAG TTCAACTGGTACGTGGACGGCGTGGAGGTGCATA ATGCCAAGACAAAGCCGCGGGAGGAGCAGTACAA CAGCACGTACCGTGTGGTCAGCGTCCTCACCGTCC TGCACCAGGACTGGCTGAATGGCAAGGAGTACAA GTGCAAGGTCTCCAACAAAGCCCTCGGCGCCCCC ATCGAGAAAACCATCTCCAAAGCCAAAGGGCAGC CCCGAGAACCACAGGTGTACACCCTGCCCCCCTGC AGAGATGAGCTGACCAAGAACCAGGTGTCCCTGT GGTGTCTGGTCAAGGGCTTCTACCCCAGCGATATC GCCGTGGAGTGGGAGAGCAACGGCCAGCCTGAGA ACAACTACAAGACCACCCCCCCTGTGCTGGACAG CGACGGCAGCTTCTTCCTGTACTCCAAACTGACCG TGGACAAGAGCCGGTGGCAGCAGGGCAACGTGTT CAGCTGCAGCGTGATGCACGAGGCCCTGCACAAC CACTACACCCAGAAGTCCCTGAGCCTGAGCCCCG GCGGAGGCGGCGAAGCGGAGGAGGAGGATCCG GAGGAGGGGGAAGTGGCGGCGGAGGATCTGAGG TGCAATTGTTGGAGTCTGGGGGAGGCTTGGTACA GCCTGGGGGGTCCCTGAGACTCTCCTGTGCAGCCA GCGGATTCACCTTTAGCAGTTATGCCATGAGCTGG GTCCGCCAGGCTCCAGGGAAGGGGCTGGAGTGGG TCTCAGCTATTAGTGGTAGTGGTGGTAGCACATAC TACGCAGACTCCGTGAAGGGCCGGTTCACCATCTC CAGAGACAATTCCAAGAACACGCTGTATCTGCAG ATGAACAGCCTGAGAGCCGAGGACACGGCCGTAT ATTACTGTGCGAAAGGCAGCGGATTTGACTACTG GGGCCAAGGAACCCTGGTCACCGTCTCGAGC |
| 313 | (49B4) VHCH1 Fc hole VL (DP47) (nucleotide sequence, heavy chain 2) | CAGGTGCAATTGGTGCAGTCTGGGGCTGAGGTGA AGAAGCCTGGGTCCTCGGTGAAGGTCTCCTGCAA GGCCTCCGGAGGCACATTCAGCAGCTACGCTATA AGCTGGGTGCGACAGGCCCCTGGACAAGGGCTCG AGTGGATGGGAGGGATCATCCCTATCTTTGGTACA GCAAACTACGCACAGAAGTTCCAGGGCAGGGTCA CCATTACTGCAGACAAATCCACGAGCACAGCCTA |

TABLE 30-continued cDNA and amino acid sequences of mature bispecific bivalent
anti-Ox40/monovalent anti-FAP huIgG1 P329GLALA kih antibodies
(2 + 1 format) and untargeted (DP47) 2 + 1 construct

| SEQ ID NO: | Description | Sequence |
|---|---|---|
| | | CATGGAGCTGAGCAGCCTGAGATCTGAGGACACC<br>GCCGTGTATTACTGTGCGAGAGAATACTACCGTGG<br>TCCGTACGACTACTGGGGCCAAGGGACCACCGTG<br>ACCGTCTCCTCAGCTAGCACCAAGGGCCCATCGGT<br>CTTCCCCCTGGCACCCTCCTCCAAGAGCACCTCTG<br>GGGGCACAGCGGCCCTGGGCTGCCTGGTCAAGGA<br>CTACTTCCCCGAACCGGTGACGGTGTCGTGGAACT<br>CAGGCGCCCTGACCAGCGGCGTGCACACCTTCCC<br>GGCTGTCCTACAGTCCTCAGGACTCTACTCCCTCA<br>GCAGCGTGGTGACCGTGCCCTCCAGCAGCTTGGG<br>CACCCAGACCTACATCTGCAACGTGAATCACAAG<br>CCCAGCAACACCAAGGTGGACAAGAAAGTTGAGC<br>CCAAATCTTGTGACAAAACTCACACATGCCCACCG<br>TGCCCAGCACCTGAAGCTGCAGGGGGACCGTCAG<br>TCTTCCTCTTCCCCCCAAAACCCAAGGACACCCTC<br>ATGATCTCCCGGACCCCTGAGGTCACATGCGTGGT<br>GGTGGACGTGAGCCACGAAGACCCTGAGGTCAAG<br>TTCAACTGGTACGTGGACGGCGTGGAGGTGCATA<br>ATGCCAAGACAAAGCCGCGGGAGGAGCAGTACAA<br>CAGCACGTACCGTGTGGTCAGCGTCCTCACCGTCC<br>TGCACCAGGACTGGCTGAATGGCAAGGAGTACAA<br>GTGCAAGGTCTCCAACAAAGCCCTCGGCGCCCCC<br>ATCGAGAAAACCATCTCCAAAGCCAAAGGGCAGC<br>CCCGAGAACCACAGGTGTGCACCCTGCCCCCATCC<br>CGGGATGAGCTGACCAAGAACCAGGTCAGCCTCT<br>CGTGCGCAGTCAAAGGCTTCTATCCCAGCGACATC<br>GCCGTGGAGTGGGAGAGCAATGGGCAGCCGGAGA<br>ACAACTACAAGACCACGCCTCCCGTGCTGGACTCC<br>GACGGCTCCTTCTTCCTCGTGAGCAAGCTCACCGT<br>GGACAAGAGCAGGTGGCAGCAGGGGAACGTCTTC<br>TCATGCTCCGTGATGCATGAGGCTCTGCACAACCA<br>CTACACGCAGAAGAGCCTCTCCCTGTCTCCGGGTG<br>GAGGCGGCGGAAGCGGAGGAGGAGGATCCGGAG<br>GCGGCGGAAGCGGAGGGGAGGCTCTGAAATTGT<br>GCTGACCCAGAGCCCCGGCACCCTGTCACTGTCTC<br>CAGGCGAAAGAGCCACCCTGAGCTGCAGAGCCAG<br>CCAGAGCGTGTCCAGCTCTTACCTGGCCTGGTATC<br>AGCAGAAGCCCGGACAGGCCCCCAGACTGCTGAT<br>CTACGGCGCCTCTTCTAGAGCCACCGGCATCCCCG<br>ATAGATTCAGCGGCAGCGGCTCCGGCACCGACTT<br>CACCCTGACAATCAGCAGACTGGAACCCGAGGAC<br>TTTGCCGTGTATTACTGCCAGCAGTACGGCAGCAG<br>CCCCCTGACCTTTGGCCAGGGCACCAAGGTGGAA<br>ATCAAA |
| 186 | (49B4) VLCL-light chain | see Table 13 |
| 314 | (49B4) VHCH1 Fc knob VH (DP47) (heavy chain 1) | QVQLVQSGAEVKKPGSSVKVSCKASGGTFSSYAISW<br>VRQAPGQGLEWMGGIIPIFGTANYAQKFQGRVTITA<br>DKSTSTAYMELSSLRSEDTAVYYCAREYYRGPYDY<br>WGQGTTVTVSSASTKGPSVFPLAPSSKSTSGGTAAL<br>GCLVKDYFPEPVTVSWNSGALTSGVHTFPAVLQSSG<br>LYSLSSVVTVPSSSLGTQTYICNVNHKPSNTKVDKK<br>VEPKSCDKTHTCPPCPAPEAAGGPSVFLFPPKPKDTL<br>MISRTPEVTCVVVDVSHEDPEVKFNWYVDGVEVHN<br>AKTKPREEQYNSTYRVVSVLTVLHQDWLNGKEYKC<br>KVSNKALGAPIEKTISKAKGQPREPQVYTLPPCRDEL<br>TKNQVSLWCLVKGFYPSDIAVEWESNGQPENNYKT<br>TPPVLDSDGSFFLYSKLTVDKSRWQQGNVFSCSVMH<br>EALHNHYTQKSLSLSPGGGGSGGGGSGGGGSGGG<br>GSEVQLLESGGGLVQPGGSLRLSCAASGFTFSSYAM<br>SWVRQAPGKGLEWVSAISGSGGSTYYADSVKGRFTI<br>SRDNSKNTLYLQMNSLRAEDTAVYYCAKGSGFDY<br>WGQGTLVTVSS |
| 315 | (49B4) VHCH1 Fc hole VL (DP47) (heavy chain 2) | QVQLVQSGAEVKKPGSSVKVSCKASGGTFSSYAISW<br>VRQAPGQGLEWMGGIIPIFGTANYAQKFQGRVTITA<br>DKSTSTAYMELSSLRSEDTAVYYCAREYYRGPYDY<br>WGQGTTVTVSSASTKGPSVFPLAPSSKSTSGGTAAL<br>GCLVKDYFPEPVTVSWNSGALTSGVHTFPAVLQSSG<br>LYSLSSVVTVPSSSLGTQTYICNVNHKPSNTKVDKK<br>VEPKSCDKTHTCPPCPAPEAAGGPSVFLFPPKPKDTL |

TABLE 30-continued cDNA and amino acid sequences of mature bispecific bivalent anti-Ox40/monovalent anti-FAP huIgG1 P329GLALA kih antibodies (2 + 1 format) and untargeted (DP47) 2 + 1 construct

| SEQ ID NO: Description | Sequence |
|---|---|
| | MISRTPEVTCVVVDVSHEDPEVKFNWYVDGVEVHN AKTKPREEQYNSTYRVVSVLTVLHQDWLNGKEYKC KVSNKALGAPIEKTISKAKGQPREPQVCTLPPSRDEL TKNQVSLSCAVKGFYPSDIAVEWESNGQPENNYKTT PPVLDSDGSFFLVSKLTVDKSRWQQGNVFSCSVMHE ALHNHYTQKSLSLSPGGGGSGGGGSGGGGSGGGG SEIVLTQSPGTLSLSPGERATLSCRASQSVSSSYLAW YQQKPGQAPRLLIYGASSRATGIPDRFSGSGSGTDFT LTISRLEPEDFAVYYCQQYGSSPLTFGQGTKVEIK |

All genes were transiently expressed under control of a chimeric MPSV promoter consisting of the MPSV core promoter combined with the CMV promoter enhancer fragment. The expression vector also contains the oriP region for episomal replication in EBNA (Epstein Barr Virus Nuclear Antigen) containing host cells.

The bispecific anti-Ox40/anti-FAP 2+1 constructs were produced by co-transfecting HEK293-EBNA cells with the mammalian expression vectors using polyethylenimine (PEI; Polysciences Inc.). The cells were transfected with the corresponding expression vectors in a 1:1:2 ratio ("vector HC1":"vector HC2":"vector LC").

For a 200 mL production in 500 mL shake flasks, 250 million HEK293 EBNA cells were seeded 24 hours before transfection in Excell media (Sigma) with supplements. For transfection, the cells were centrifuged for 5 minutes at 210×g, and supernatant was replaced by pre-warmed CD-CHO medium (Gibco). Expression vectors were mixed in 20 mL CD-CHO medium to a final amount of 200 µg DNA. After addition of 540 µL PEI (1 mg/mL) (Polysciences Inc.), the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% CO₂ atmosphere and shaking at 165 rpm. After the incubation, 160 mL Excell medium with supplements (1 mM valproic acid, 5 g/l Pep Soy, 6 mM L-Glutamine) was added and cells were cultured for 24 hours. 24 h after transfection the cells were supplemented with an amino acid and glucose feed at 12% final volume (24 mL) and 3 g/L glucose (1.2 mL from 500 g/L stock). After culturing for 7 days, the cell supernatant was collected by centrifugation for 45 minutes at 2000-3000×g. The solution was sterile filtered (0.22 µm filter), supplemented with sodium azide to a final concentration of 0.01% (w/v), and kept at 4° C.

Purification of the bispecific constructs from cell culture supernatants was carried out by affinity chromatography using MabSelectSure. The protein was concentrated and filtered prior to loading on a HiLoad Superdex 200 column (GE Healthcare) equilibrated with 20 mM histidine, 140 mM NaCl, 0.01% Tween-20 solution of pH 6.0.

For affinity chromatography, the supernatant was loaded on a ProtA MabSelect Sure column (CV=5 mL, GE Healthcare) equilibrated with 30 mL 20 mM Sodium Citrate, 20 mM Sodium Phosphate, pH 7.5. Unbound protein was removed by washing with 6-10 column volumes of a buffer containing 20 mM sodium phosphate, 20 mM sodium citrate (pH 7.5). The bound protein was eluted using either a step or a linear pH-gradient of 20 CVs (from 0 to 100%) of 20 mM Sodium Citrate, 100 mM Sodium Chloride, 100 mM Glycine, 0.01% (v/v) Tween-20, pH 3.0. The column was then washed with 10 column volumes of a solution containing 20 mM Sodium Citrate, 100 mM sodium chloride, 100 mM glycine, 0.01% (v/v) Tween-20, pH 3.0 followed by a re-equilibration step.

The pH of the collected fractions was adjusted by adding ¹/₁₀ (v/v) of 0.5 M sodium phosphate, pH8.0. The protein was concentrated and filtered prior to loading on a HiLoad Superdex 200 column (GE Healthcare) equilibrated with 20 mM histidine, 140 mM sodium chloride, pH 6.0, 0.01% Tween20.

The protein concentration of purified bispecific constructs was determined by measuring the OD at 280 nm, using the molar extinction coefficient calculated on the basis of the amino acid sequence. Purity and molecular weight of the bispecific constructs were analyzed by CE-SDS in the presence and absence of a reducing agent (Invitrogen) using a LabChipGXII (Caliper). The aggregate content of bispecific constructs was analyzed using a TSKgel G3000 SW XL analytical size-exclusion column (Tosoh) equilibrated in a 25 mM potassium phosphate, 125 mM sodium chloride, 200 mM L-arginine monohydrochloride, 0.02% (w/v) NaN₃, pH 6.7 running buffer at 25° C. (Table 31).

TABLE 31

Biochemical analysis of exemplary bispecific, tetravalent anti-Ox40/anti-FAP IgG1 P329G LALA antigen binding molecules (2 + 1 constructs)

| Clone | Yield [mg/l] | Monomer [%] | CE-SDS (non red) | CE-SDS (red) |
|---|---|---|---|---|
| OX40(49B4)/FAP(28H1) P329GLALA IgG1 2 + 1 | 8.3 | 97.25 (0.75 HMW) | 100 | 73.7% (81.6 kDa) 0.13% (30.9 kDa) 26.8% (29.5 kDa) |
| OX40(49B4)/FAP(4B9) | 7.85 | 99.25 | 100 | 58.71% (80.44 kDa) |

TABLE 31-continued

Biochemical analysis of exemplary bispecific, tetravalent anti-Ox40/anti-FAP IgG1 P329G LALA antigen binding molecules (2 + 1 constructs)

| Clone | Yield [mg/l] | Monomer [%] | CE-SDS (non red) | CE-SDS (red) |
|---|---|---|---|---|
| P329GLALA IgG1 2 + 1 OX40(49B4)/DP47 P329GLALA IgG1 2 + 1 | 5.76 | (0.75 HMW) 97.63 (1.33 HMW) | 100 | 41.29% (28.91 kDa) 73.47% (81.39 kDa) 0.11% (30.67 kDa) 26.42% (29.42 kDa) |

4.5 Characterization of Bispecific 2+1 Constructs Targeting Ox40 and FAP

4.5.1 Binding to FAP (Surface Plasmon Resonance)

The capacity of the bispecific constructs to bind human, murine and cynomolgus FAP was assessed by surface plasmon resonance (SPR). All SPR experiments were performed on a Biacore T200 (Biacore) at 25° C. with HBS-EP as running buffer (0.01 M HEPES pH 7.4, 0.15 M NaCl, 3 mM EDTA, 0.005% Surfactant P20, (Biacore).

Figure 12E:
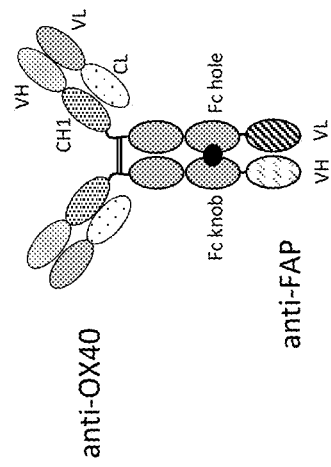
FIG. 12E shows the setup for the SPR experiments demonstrating binding to FAP as described in Example 5.4.1.

His-tagged human, murine or cynomolgus monkey dimeric FAP was captured on a CM5 chip (GE Healthcare) immobilized with anti-His antibody (Qiagen Cat. No. 34660) by injection of 500 nM huFAP for 60 s at a flow rate of 10 uL/min, 10 nM murine FAP for 20 s at a flow rate of 20 uL/min and 10 nM cynoFAP for 20 s at a flow rate of 20 uL/min. Immobilization levels for the anti-His antibody of up to 18000 resonance units (RU) were used. The setup of the assay is shown in FIG. 12E.

Following the capture step, the bispecific constructs as well as control molecules were immediately passed over the chip surface at a concentration ranging from 0.78-100 nM with a flow rate of 30 μL/minute for 280 s and a dissociation phase of 180 s. Bulk refractive index differences were corrected for by subtracting the response obtained in a reference flow cell, where no FAP was immobilized. Affinity was determined using the Langmuir 1:1 curve fitting. For bivalent binding the same 1:1 fitting was used leading to an apparent KD value.

TABLE 32

Binding of exemplary bispecific anti-Ox40/anti-FAP antigen binding molecules to recombinant human FAP, murine FAP and cynomolgus FAP

| Construct | hu FAP $K_D$ (M) | mu FAP $K_D$ (M) | cyno FAP $K_D$ (M) |
|---|---|---|---|
| OX40(49B4)/FAP(28H1) P329GLALA IgG1 2 + 1 | 1.9E-08 | 3.3E-10 | 3.1E-08 |
| OX40(49B4)/FAP(4B9) P329GLALA IgG1 2 + 1 | 1.0E-09 | 1.1E-07 | 8.5E-10 |
| OX40(49B4)/DP47 P329GLALA IgG1 2 + 1 | n.d. | n.d. | n.d. |

Note:
All $K_D$s are dependent from the specific experimental conditions.

4.5.2 Binding to humanOX40—Competition Binding of Bivalent Ox40 Binding

Figure 13E:
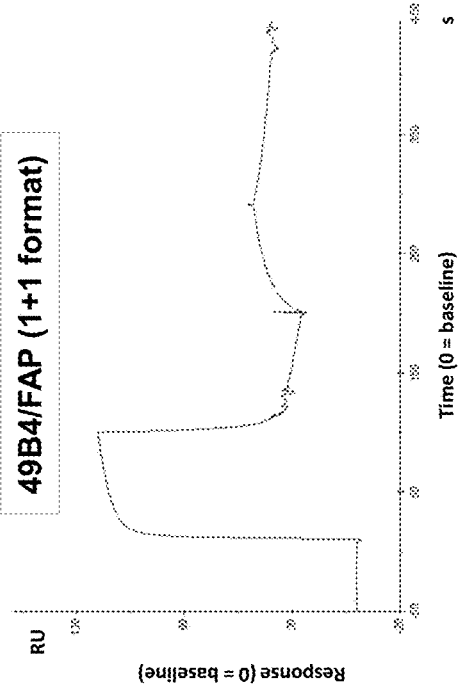
Figure 13F:
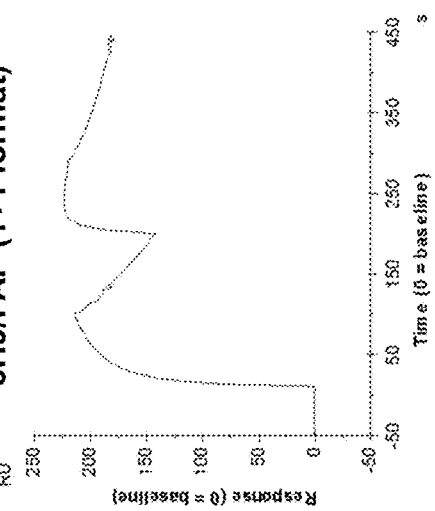
Figure 13G:
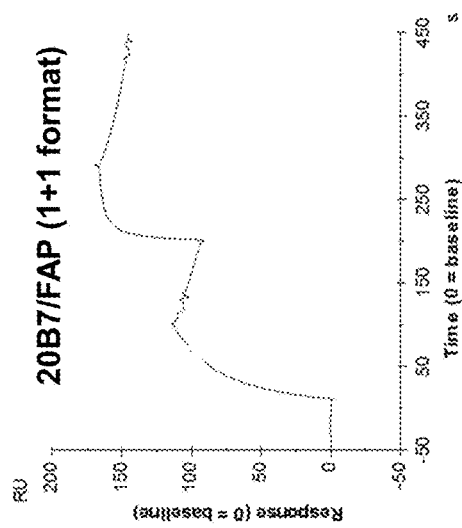
Figure 13H:
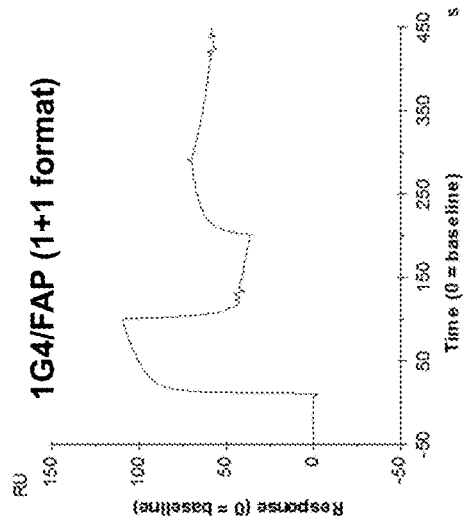
Figure 13M:
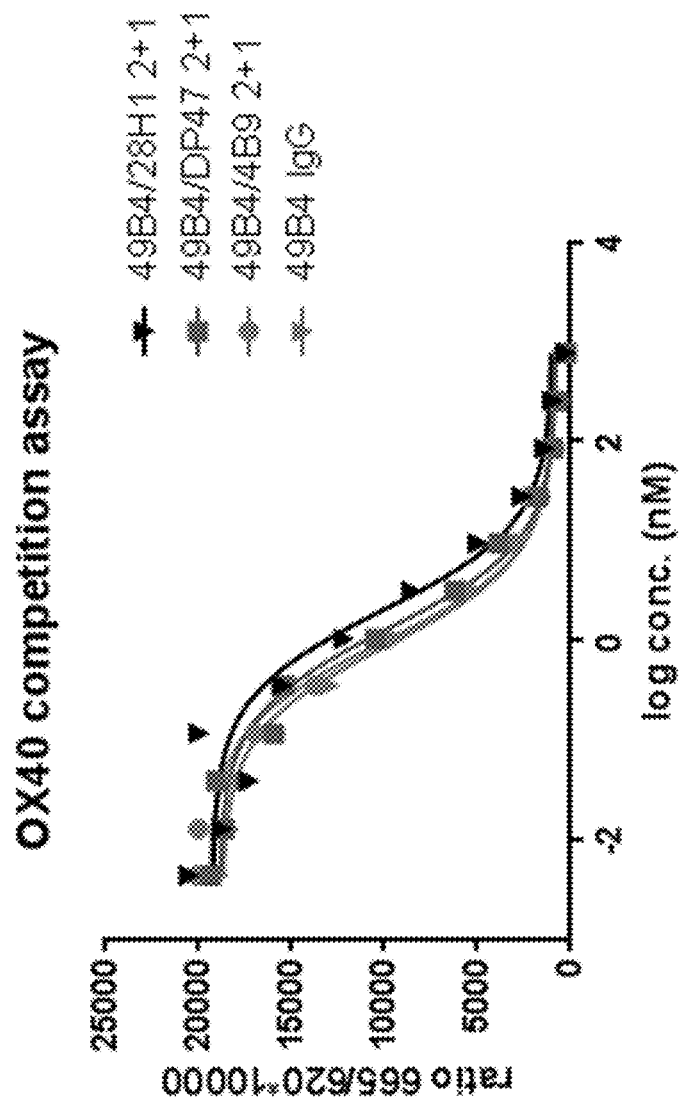

To confirm the ability of all two anti-OX40 Fab domains to bind to huOX40 comparable to an IgG, a cell-based FRET assay (TagLite) was applied. Therefore, 10000 Hek293 EBNA cells/well transfected with huOX40-SNAP fusion and labeled with the FRET donor Terbium (Cisbio) were mixed with 0.2 nM (49B4) IgG labeled with the FRET acceptor d2 (Cisbio). Additionally, a concentration dilution ranging from 0.004-750 nM from either (49B4) IgG or bispecific construct 49B4/28H1 (2+1) was added and incubated for 2-4 hours at RT. The fluorescent signal was measured at 620 nm for the fluorescent donor (Terbium) and at 665 nm for the fluorescent acceptor dye (M100 Pro, Tecan). The ratio of 665/620*1000 was calculated, and the reference (cells only) was subtracted (FIG. 13M). For $EC_{50}$ determination the results were analysed in Graph Pad Prism5. The observed $EC_{50}$ values are shown in Table 33. All 2+1 constructs showed a similar $EC_{50}$ than the bivalent IgG under these experimental conditions.

TABLE 33

$EC_{50}$ values for competition binding of IgG vs bivalent 2 + 1 OX40 antigen binding molecules; t = 2 h

| Construct | $EC_{50}$ (nM) |
|---|---|
| 49B4 IgG1 | 0.87 (0.64-1.2) |
| OX40(49B4)/FAP(28H1) P329GLALA IgG1 2 + 1 | 1.96 (1.22-3.14) |
| OX40(49B4)/FAP(4B9) P329GLALA IgG1 2 + 1 | 0.93 (0.7-1.22) |
| OX40(49B4)/FAP(DP47) P329GLALA IgG1 2 + 1 | 1.28 (0.95-1.72) |

4.5.3 Simultaneous Binding to OX40 and FAP

The capacity of binding simultaneously human OX40 Fc (kih) and human FAP was assessed by surface plasmon resonance (SPR). All SPR experiments were performed on a Biacore T200 (Biacore) at 25° C. with HBS-EP as running buffer (0.01 M HEPES pH 7.4, 0.15 M NaCl, 3 mM EDTA, 0.005% Surfactant P20 (Biacore).

Biotinylated human OX40 Fc (kih) was directly coupled to a flow cell of a streptavidin (SA) sensor chip. Immobilization levels up to 1000 resonance units (RU) were used.

Figure 12F:
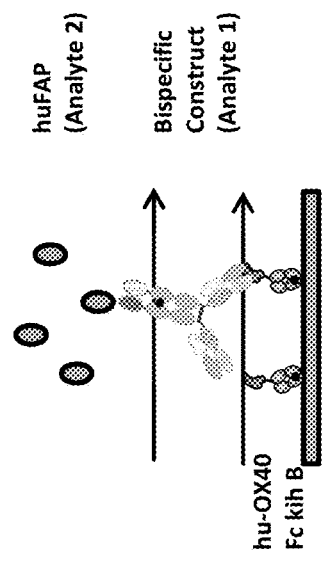
FIG. 12F shows how simultaneous binding to immobilized human OX40 and human FAP was measured (Example 5.4.1).

The bispecific antibodies targeting OX40 and FAP were passed over the chip surface at a concentration of 250 nM with a flow rate of 30 μL/minute for 90 seconds and dissociation was set to zero sec. Human FAP was injected as second analyte with a flow rate of 30 μL/minute for 90 seconds at a concentration of 250 nM (see FIG. 12F). The dissociation was monitored for 120 sec. Bulk refractive index differences were corrected for by subtracting the response obtained in a reference flow cell, where no protein was immobilized.

All bispecific constructs could bind simultaneously to human OX40 and human FAP (FIGS. 13J-13L).

4.5.4 Binding on Cells

4.5.4.1 Binding to Naïve Versus Activated Human PBMCs of Bispecific Antibodies Targeting OX40 and FAP Human PBMC were isolated by ficoll density gradient centrifugation as described in Example 2.1.2. PBMCs were used directly after isolation (binding on resting human PBMCs) or they were stimulated to receive a strong human Ox40 expression on the cell surface of T cells (binding on activated human PBMCs). Therefore naïve PBMCs were cultured for four days in T cell medium supplied with 200 U/mL Proleukin and 2 µg/mL PHA-L in 6-well tissue culture plate and then 1 day on pre-coated 6-well tissue culture plates [4 µg/mL anti-human CD3 (clone OKT3) and 2 µg/mL anti-human CD28 (clone CD28.2)] in T cell medium supplied with 200 U/mL Proleukin at 37° C. and 5% $CO_2$.

For detection of OX40 naïve human PBMC and activated human PBMC were mixed. To enable distinction of naïve from activated human PBMC naïve cells were labeled prior to the binding assay using the eFluor670 cell proliferation dye (eBioscience, Cat.-No. 65-0840-85). A 1 to 1 mixture of $1\times10^5$ naïve, eFluor670 labeled human PBMC and unlabeled activated human PBMC were then added to each well of a round-bottom suspension cell 96-well plates (greiner bio-one, cellstar, Cat. No. 650185) and the binding assay was performed as described in Example 2.1.2. A 1 to 1 mixture of 1×105 naïve, eFluor670 labeled human PBMC and unlabeled activated human PBMC were then added to each well of a round-bottom suspension cell 96-well plates (greiner bio-one, cellstar, Cat. No. 650185) and binding assay was performed as described in section 2.1.2.

Primary antibodies were titrated anti-Ox40 antibody constructs, incubated for 120 minutes at 4° C. Secondary antibody solution was a mixture of fluorescently labeled anti-human CD4 (clone RPA-T4, mouse IgG1 k, BioLegend, Cat.-No. 300532), anti-human CD8 (clone RPa-T8, mouse IgG1k, BioLegend, Cat.-No. 3010441) and Fluorescein isothiocyanate (FITC)-conjugated AffiniPure anti-human IgG Fcγ-fragment-specific goat IgG F(ab')$_2$ fragment (Jackson ImmunoResearch, Cat.-No. 109-096-098), incubated for 60 minutes at 4° C. in the dark. Plates were finally resuspended in 90 µL/well FACS-buffer containing 0.2 µg/mL DAPI (Santa Cruz Biotec, Cat. No. Sc-3598) and acquired the same day using 5-laser LSR-Fortessa (BD Bioscience with DIVA software).

As shown in FIGS. 14J and 14Q, no antigen binding molecule specific for Ox40 bound to resting human CD4$^+$ T-cells or CD8$^+$ T-cells. In contrast, all antigen binding molecules bound to activated CD8$^+$ or CD4$^+$ T-cells. Binding to CD4$^+$ T-cells was much stronger than that to CD8$^+$ T cells similar to what was described already in Example 4.3.2.1. As shown in FIGS. 14K and 14M, the bivalent FAP-targeted OX40 constructs showed stronger binding characteristics to OX40 positive cells as respective clone in a monovalent antibody format, due to the gain of avidity. All formats of a 2+1 design bound with similar strength to OX40 positive cells, independently of the binding moiety of the second specificity (FIGS. 14O and 14Q).

4.5.4.2 Binding to Human FAP-expressing Tumor Cells

The binding to cell surface FAP was tested using human fibroblast activating protein (huFAP) expressing WM266-4 cells (ATCC CRL-1676). The lack of binding to OX40 negative FAP negative tumor cells was tested using A549 NucLight™ Red Cells (Essenbioscience, Cat. No. 4491) expressing the NucLight Red fluorescent protein restricted to the nucleus to allow separation from unlabeled human FAP positive WM266-4 cells. Parental A549 (ATCC CCL-185) were transduced with the Essen CellPlayer NucLight Red Lentivirus (Essenbioscience, Cat. No. 4476; EF1α, puromycin) at an MOI of 3 (TU/cell) in the presence of 8 µg/ml polybrene following the standard Essen protocol. This resulted in ≥70% transduction efficiency.

A mixture of 5×104 unlabeled WM266-4 cells and unlabeled A549 NucLight™ Red Cells in FACS buffer were added to each well of a round-bottom suspension cell 96-well plates (Greiner bio-one, Cellstar, Cat. No. 650185) and the binding assay was performed in a similar manner as described in Example 4.3.2.2. Plates were centrifuged 4 minutes, 400×g at 4° C. and supernatants were flicked off. Cells were washed once with 200 µL DPBS and pellets were resuspended by a short and gentle vortex. All samples were resuspended in 50 µL/well of 4° C. cold FACS buffer containing the bispecific antigen binding molecules (primary antibody) at the indicated range of concentrations (titrated) and incubated for 120 minutes at 4° C. Afterwards the cells were washed four times with 200 µL/well 4° C. FACS buffer and resuspended by a short vortex. Cells were further stained with 25 µL/well of 4° C. cold secondary antibody solution containing Fluorescein isothiocyanate (FITC)-conjugated AffiniPure anti-human IgG Fcγ-fragment-specific goat IgG F(ab')$_2$ fragment (Jackson ImmunoResearch, Cat. No. 109-096-098) and incubated for 60 minutes at 4° C. in the dark. Plates were finally resuspended in 90 µL/well FACS-buffer containing 0.2 µg/mL DAPI (Santa Cruz Biotec, Cat. No. Sc-3598) and acquired the same day using 5-laser LSR-Fortessa (BD Bioscience with DIVA software).

Figure 15F:
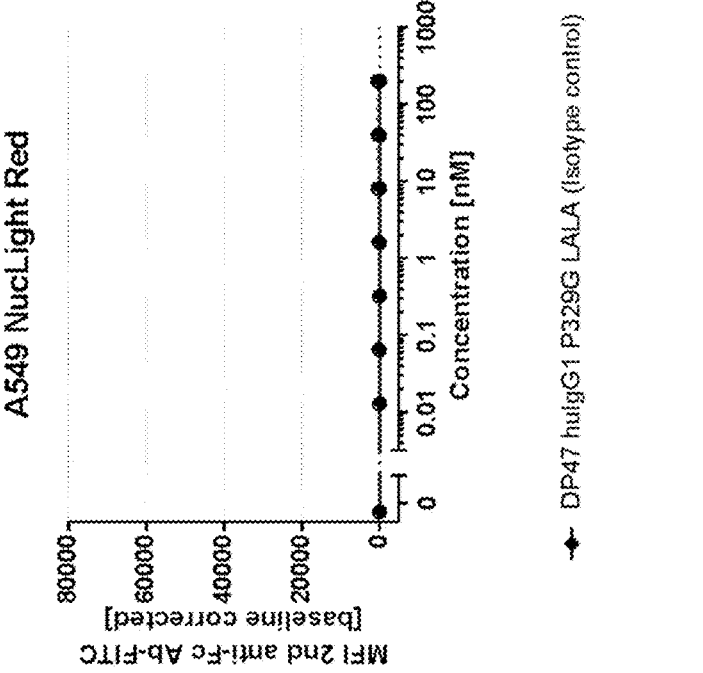
Figure 15E:
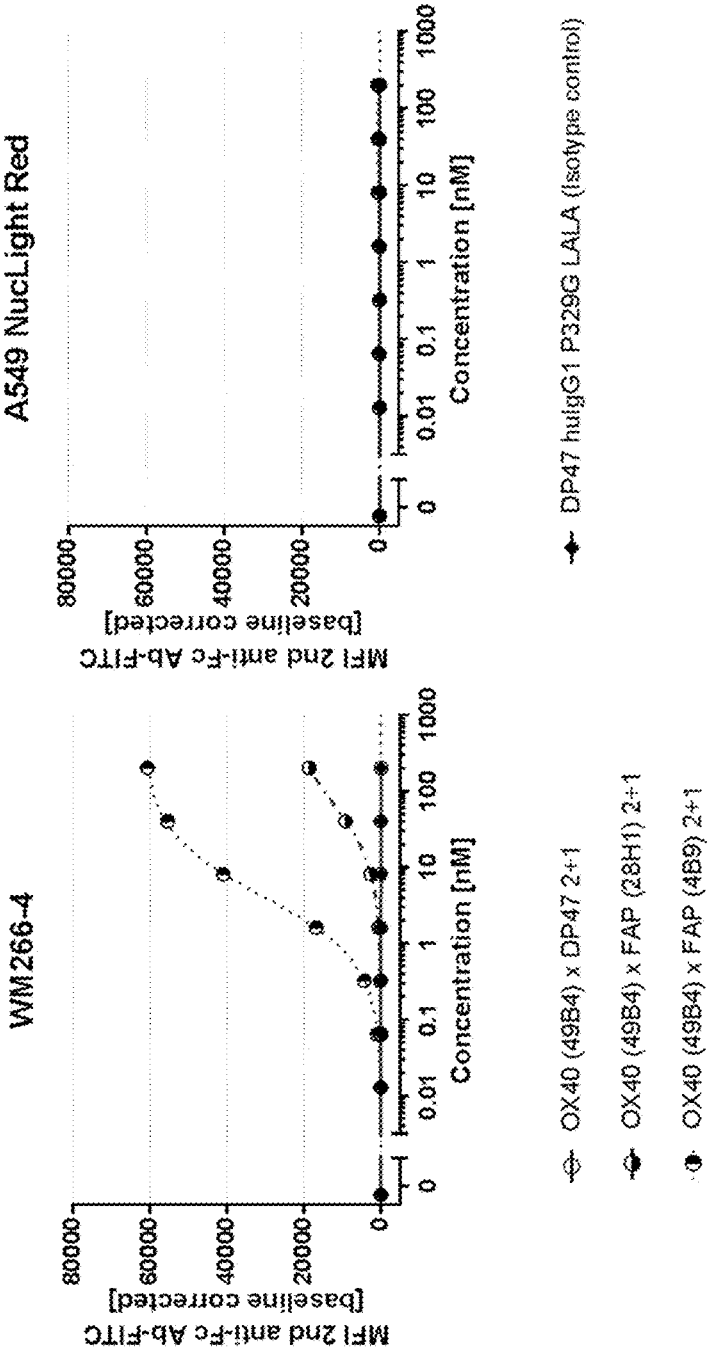
Figure 16A:
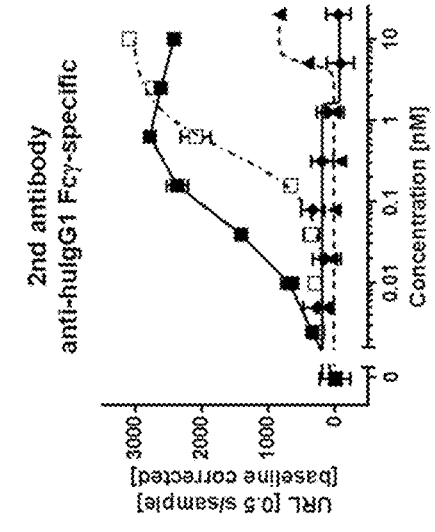
Figure 16B:
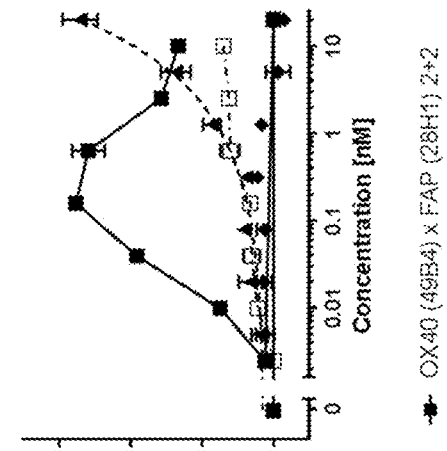
Figure 16C:
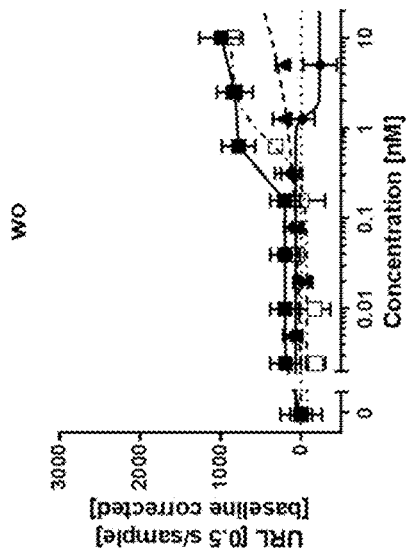
Figure 16D:
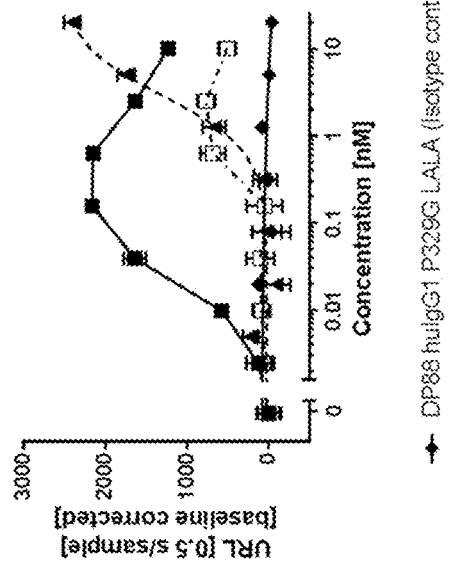
Figure 16M:
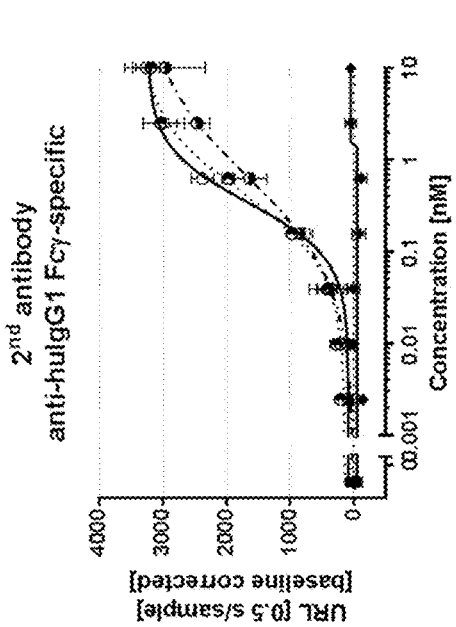
Figure 16L:
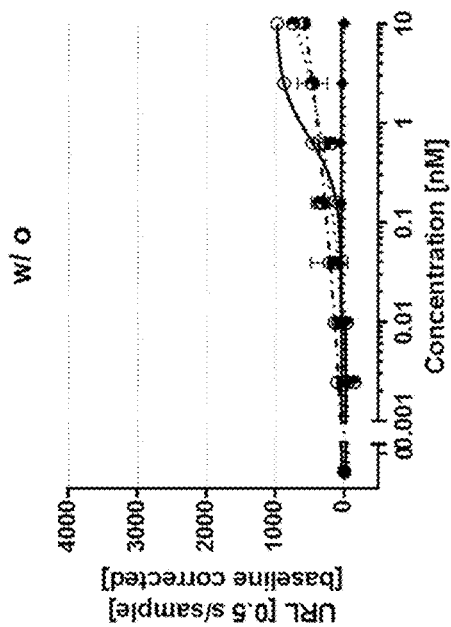
Figure 16N:
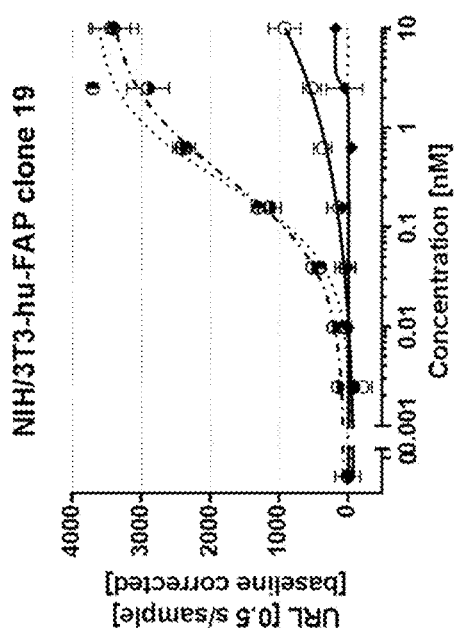

As shown in FIGS. 15C and 15E, the FAP-targeted mono- and bivalent anti-OX40 antigen binding molecules bounds efficiently to human FAP-expressing target cells. Therefore only FAP-targeted mono- and bivalent anti-OX40 antigen binding molecules show direct tumor-targeting properties. The high affinity FAP binding clone 4B9 showed in a monovalent construct a stronger binding to human FAP than the respective FAP binding clone 28H1 in the same monovalent format (FIG. 15E). No FAP was detected for 2+1 constructs lacking a FAP binding domain (open circle, FIG. 15F). $EC_{50}$ values of binding to activated human CD4$^+$ T cells and FAP positive tumor cells are summarized in Table 34.

TABLE 34

$EC_{50}$ values for binding of aOx40 binder (clone 49B4) in a FAP targeted mono or bivalent format to cell surface human FAP and human Ox40

| Clone | Format | FAP$^+$ cell $EC_{50}$ [nM] | OX40$^+$ cell $EC_{50}$ [nM] |
|---|---|---|---|
| 49B4, 28H1 | FAP 1 + 1 | 1.0 | 123.1 |
|  | FAP 2 + 1 | 70.8 | 6.5 |
|  | FAP 2 + 2 | 1.2 | 6.1 |
| 49B4, 4B9 | FAP 2 + 1 | 4.1 | 9.0 |
| 49B4, DP47 | FAP 2 + 1 | 5.99 | 9.0 |

Example 5

Functional Properties of Bispecific Anti-human OX40 Binding Molecules 5.1 HeLa Cells Expressing Human OX40 and Reporter Gene NFκB-luciferase As shown in Example 3.1, a limited, dose dependent NFκB activation was induced by addition of anti-OX40 P329GLALA huIgG1 antibodies to the HeLa_hOX40_NFkB_Luc1 reporter cell line. Hyper-crosslinking of anti-OX40 antibodies by anti-human IgG specific secondary antibodies strongly increased the induction of NFκB-mediated luciferase-activation in a concentration-dependent manner. Consequently, we tested the NFκB activating capacity of selected anti-OX40 binders (8H9, 1G4, 49B9) in a monovalent and bivalent FAP-targeted format alone and with hyper-crosslinking of the constructs by either a secondary antibody or a FAP$^+$ tumor cell line.

As described in Example 3.1, adherent HeLa_hOX40_NFκB_Luc1 cells were cultured over night at a cell density of 0.3*10$^5$ cells per well and were stimulated for 5 to 6 hours with assay medium containing titrated anti-OX40 binders (clone 8H9 and 1G4) in the FAP targeted monovalent (FAP 1+1) and bivalent (FAP 2+2) format and as P329GLALA hu IgG1 constructs. For testing the effect of hyper-crosslinking by secondary antibodies, 25 µL/well of medium containing secondary antibody anti-human IgG Fcγ-fragment-specific goat IgG F(ab')$_2$ fragment (Jackson ImmunoResearch, 109-006-098) was added in a 1:2 ratio (primary to secondary antibodies). To test the effect of hyper-crosslinking by cell surface FAP binding, 25 µL/well of medium containing FAP$^+$ tumor cells (WM266-4 and/or NIH/3T3-huFAP clone 39) were co-cultured in a 2 to 1 ratio (twice as much FAP$^+$ tumor cells than reporter cells per well). Activated NFκB was quantified by measuring light emission using luciferase 1000 assay system and the reporter lysis buffer (both Promega, Cat.-No. E4550 and Cat-No: E3971) as described in Example 3.1.

As shown in FIGS. 16A-16G, the presence of all anti-OX40 constructs induced a limited NFκB activation. Hyper-crosslinking via secondary anti-huIgG Fcγ-specific antibody increased this NFκB activation for both binders in a huIgG1 P329GLALA as well as in a FAP targeted mono/bivalent format. Monovalent binding to OX40 was thereby less efficient than bivalent binding to OX40, which showed the necessity of OX40 receptor oligomerization to fully activate the OX40 signaling axis. FAP-expressing tumor cell strongly increased induction of NFκB-mediated luciferase-activation in a concentration-dependent manner when FAP targeted molecules (filled square and triangle) were used. No such effect was seen when the same clones in a non-targeted huIgG1 P329GLALA format were used as the construct could not be further hyper-crosslinked by FAP$^+$ tumor cells. Again the bivalent molecule was superior to the monovalent molecule. A high expression of FAP ensured higher cross-linking and thus a better agonistic effect of the FAP targeted construct (compare filled diamond for FAP high NIH/3T3-huFAP clone 39 and FAP positive WM266-4 cells). The bivalent FAP targeted construct showed in the presence of FAP$^+$ tumor cells a peak activity at a concentration of ~0.1 to 1 nM. Further increase of compound concentration actually decreased its ability to induce NFκB. Most likely, bivalent constructs binding to only one target (FAP or OX40) were present at higher concentrations, out-competing constructs binding simultaneously to FAP and OX40. This loss of cross-linking reduced in turn the agonistic OX40 signaling.

In a further experiment, adherent HeLa_hOX40_NFκB_Luc1 cells were cultured over night at a cell density of 0.2*10$^5$ cells per well and were stimulated for 5 hours with assay medium containing titrated anti-OX40 binders (clone 49B9) in the FAP targeted monovalent (FAP 1+1) and bivalent (FAP 2+1 and FAP 2+2) format and as P329GLALA hu IgG1 constructs. FAP was targeted in the 2+1 with two different FAP binding clones, 28H1 with low affinity to FAP and 4B9 with high affinity for FAP. For testing the effect of hyper-crosslinking by secondary antibodies, 25 µL/well of medium containing secondary antibody anti-human IgG Fcγ-fragment-specific goat IgG F(ab')$_2$ fragment (Jackson ImmunoResearch, 109-006-098) was added in a 1:2 ratio (primary to secondary antibodies). To test the effect of hyper-crosslinking by cell surface FAP binding, 25 µL/well of medium containing FAP$^+$ tumor cells (NIH/3T3-huFAP clone 19) were co-cultured in a 4 to 1 ratio (four time as much FAP$^+$ tumor cells than reporter cells per well). Activated NFκB was quantified by measuring light emission using luciferase 1000 assay system and the reporter lysis buffer (both Promega, Cat.-No. E4550 and Cat-No: E3971) as described in Example 3.1.

As shown in FIGS. 16H-16N, also in this experiment the presence of all anti-OX40 constructs induced a limited NFκB activation. Hyper-crosslinking via secondary anti-huIgG Fcγ-specific antibody increased this NFκB activation for all binders in a FAP targeted mono/bivalent format. Monovalent binding to OX40 was thereby less efficient than bivalent binding to OX40, which showed the necessity of OX40 receptor oligomerization to fully activate the OX40 signaling axis (FIG. 16J, compare EC$_{50}$ values). FAP-expressing tumor cells strongly increased induction of NFκB-mediated luciferase-activation in a concentration-dependent manner when FAP targeted molecules (filled square, triangle, semi-filled circles) were used. No such effect was seen when in the 2+1 format the FAP binding moiety was replaced by a non-binding DP47 unit (open circle) as the construct could not be further hyper-crosslinked by FAP$^+$ tumor cells. Again the bivalent molecule was superior to the monovalent molecule (compare EC$_{50}$ values). The monovalent FAP targeted and bivalent OX40 targeted construct (2+1) showed in the presence of FAP$^+$ tumor cells the highest plateau activity. In contrast to the monovalent OX40 binding 1+1 construct the bivalent binding to OX40 of the 2+1 format increased the agonistic capacity by oligomerization of OX40 (effect on EC$_{50}$ value). Due to the monovalent binding of the 2+1 constructs to FAP, however, it seems that twice as much molecules could be crosslinked compared to the bivalent FAP binding 2+2 format which could explain the higher plateau OX40 activation (FIG. 16K, higher plateau).

5.2 OX40 Mediated Costimulation of Suboptimally TCR Triggered Pre-activated Human CD4 T Cells Selected binders (clone 8H9 and 1G4) in a FAP targeted monovalent or bivalent format were also tested for their ability to co-activate T cells when they were surface immobilized.

As described in Example 3.2, pre-activated CFSE-labeled OX40 positive CD4 T-cells were stimulated for 72 hours with a suboptimal concentration of plate-immobilized anti-CD3 antibodies in the presence of titrated anti-Ox40 antibodies immobilized on the plate surface. Effects on T-cell survival and proliferation were analyzed through monitoring of total cell counts and CFSE dilution in living cells by flow cytometry. Additionally, cells were co-stained with fluorescently-labeled antibodies against T-cell activation and differentiation markers, e.g. CD127, CD45RA, Tim-3, CD62L and OX40 itself.

Figure 17B:
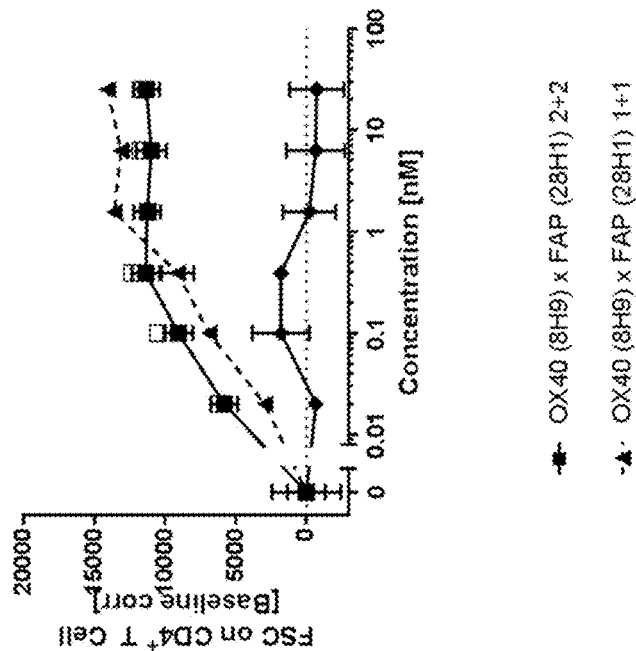
FIGS. 17A and 17B show the rescue of suboptimal TCR restimulation of preactivated CD4 T cells with plate-immobilized FAP targeted mono and bivalent anti-OX40 (1G4 and 8H9) constructs. Costimulation with plate-immobilized anti-Ox40 binders (huIgG1 P329GLALA format) promoted cell proliferation and maturation of sub-optimally restimulated human CD4 T cells and induced an enhanced activated phenotype. PHA-L pre-activated CFSE-labeled human CD4 T cells were cultured for four days on plates pre-coated with mouse IgG Fcγ spec. antibodies, human IgG Fcγ spec. antibodies (both 2 µg/mL), mouse anti-human CD3 antibodies (clone OKT3, [3 ng/mL]) and titrated anti-Ox40 binders (huIgG1 P329GLALA format). Shown is the event count, the percentage of proliferating (CFSE-low) cells, the percentage of effector T cells (CD127low CD45RAlow) and the percentage of CD62L low, OX40 positive or Tim-3 positive cells at day 4. Baseline values of samples containing only the plate-immobilized anti-human CD3 were substracted. Therefore, the enhancing effect of OX40 stimulation but not the effect of suboptimal anti-CD3 stimulation per se is visible here. It can be seen that all constructs containing clone 8H9 were able to rescue suboptimal TCR stimulation of preactivated, Ox40+ CD4 T cells when coated to plate. Cells showed a more activated (Tim3+ FSC+) phenotype. Bivalent constructs performed slightly better than monovalent constructs.
Figure 17A:
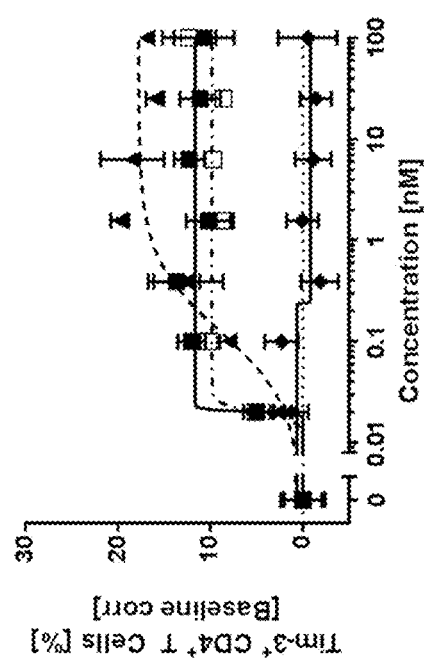
Figure 18A:
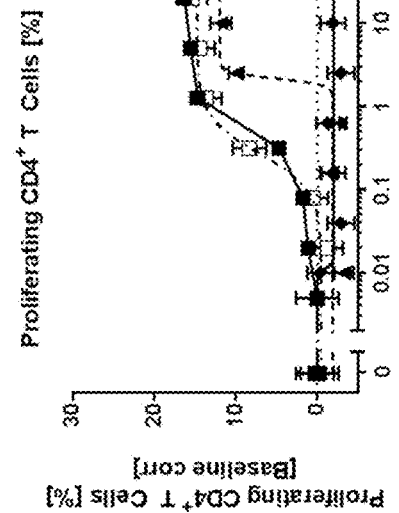
FIGS. 18A, 18B, 18C and 18D show the rescue of suboptimal TCR restimulation of preactivated CD4 T cells with plate-immobilized FAP targeted mono and bivalent anti-OX40 (1G4 and 8H9) constructs. Costimulation with plate-immobilized anti-Ox40 binders (huIgG1 P329GLALA format) promoted cell proliferation and maturation of sub-optimally restimulated human CD4 T cells and induced an enhanced activated phenotype. PHA-L pre-activated CFSE-labeled human CD4 T cells were cultured for four days on plates pre-coated with mouse IgG Fc☐ spec. antibodies, human IgG Fc☐ spec. antibodies (both 2 ☐g/mL), mouse anti-human CD3 antibodies (clone OKT3, [3 ng/mL]) and titrated anti-Ox40 binders (huIgG1 P329GLALA format). Shown is the event count, the percentage of proliferating (CFSE-low) cells, the percentage of effector T cells (CD127low CD45RAlow) and the percentage of CD62L low, OX40 positive or Tim-3 positive cells at day 4. Baseline values of samples containing only the plate-immobilized anti-human CD3 were substracted. Therefore, the enhancing effect of OX40 stimulation but not the effect of suboptimal anti-CD3 stimulation per se is visible here. It can be observed that all constructs containing clone 1G4 were able to rescue suboptimal TCR stimulation of preactivated, Ox40+ CD4 T cells when coated to plate. Cells proliferate more and present an activated (Tim3+ Ox40+) phenotype. Bivalent constructs perform better than monovalent constructs. Both bivalent constructs performed comparable when coated to plate.
Figure 18B:
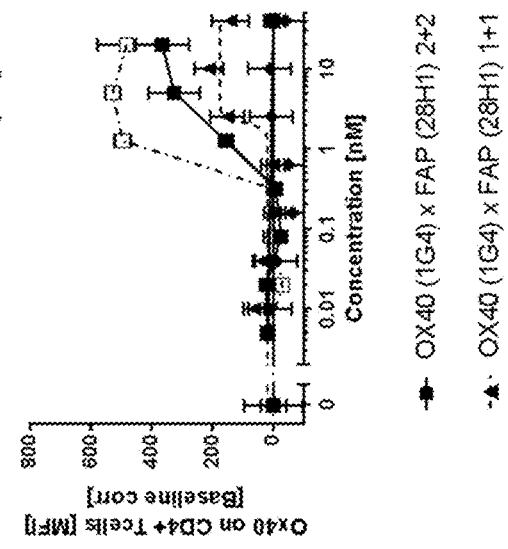
Figure 18C:
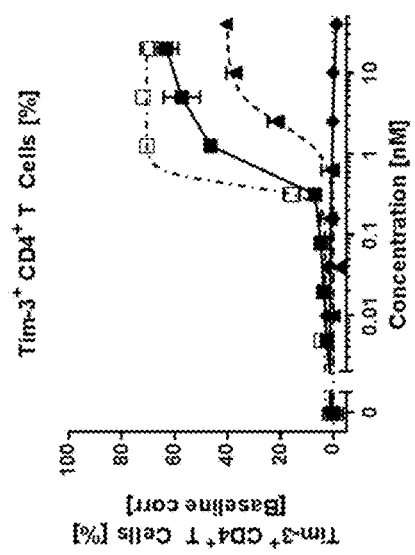
Figure 18D:
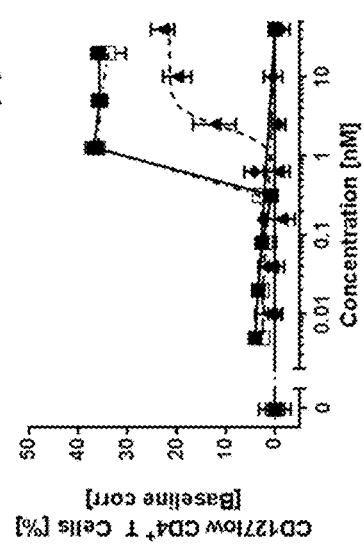
Figure 19:
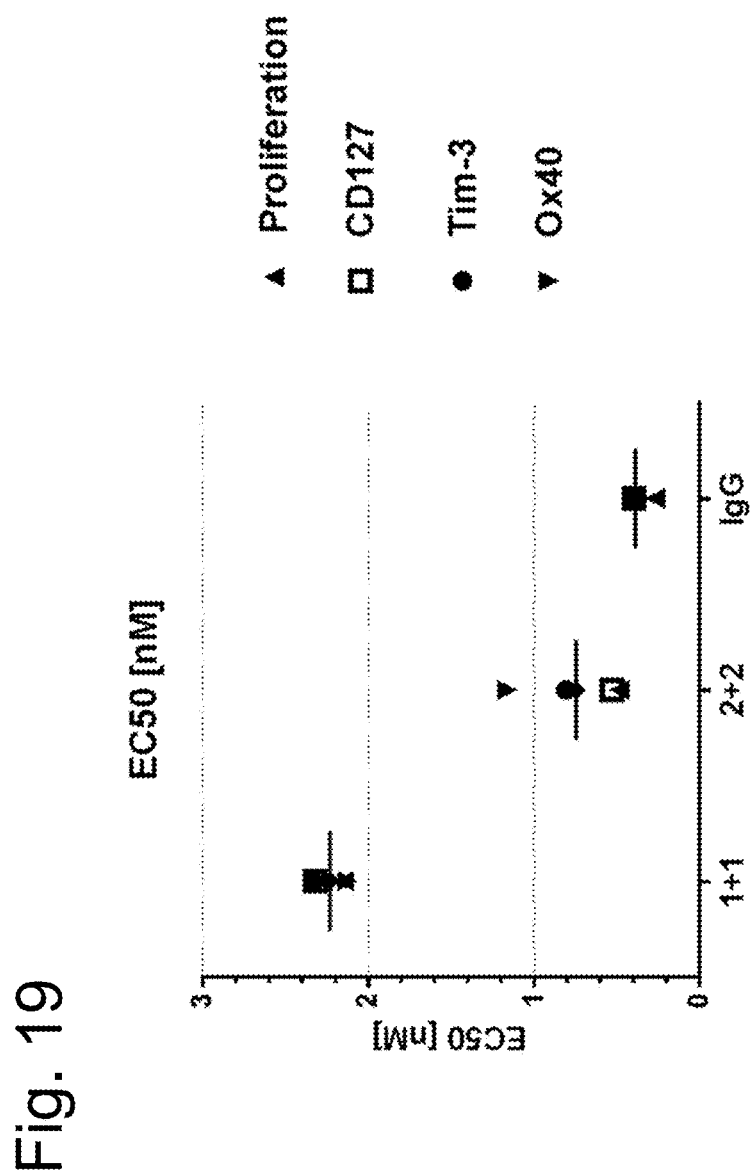
FIG. 19 the $EC_{50}$ values as calculated from rescuing suboptimal TCR stimulation with plate-immobilized FAP targeted mono and bivalent anti-OX40 (clone 1G4) constructs are shown. The percentage of proliferating (CFSE-low) cells and the percentage of CD127L low, Tim-3 positive and OX40 positive cells at day 4 were plotted vs the anti-OX40 antibody concentration and $EC_{50}$ values as measure for agonistic strength were calculated using the inbuilt sigmoidal dose response quotation in Prism4 (GraphPad Software, USA). All constructs containing clone 1G4 were able to rescue suboptimal TCR stimulation of preactivated, Ox40+ CD4 T cells when coated to plate. However, the bivalent (2+2) constructs performed better than monovalent (1+1) constructs.
Figure 20A:
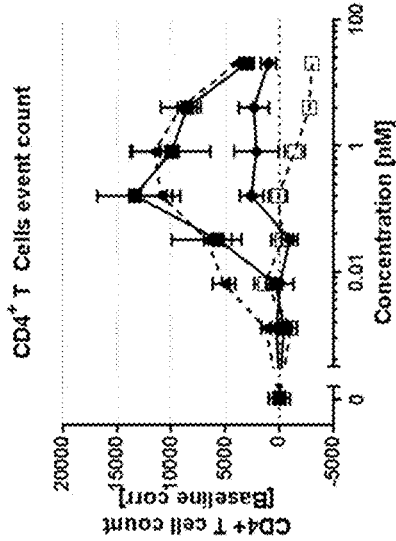
FIGS. 20A, 20B, 20C, 20D, 20E, 20F, 20G and 20H relate to the OX40 mediated costimulation of suboptimally TCR triggered resting human PBMC and hypercrosslinking by cell surface FAP. Only constructs containing FAP binding moiety were able to rescue suboptimal TCR stimulation of preactivated, Ox40+ CD4 T cells when crosslinking was provided by FAP positive cells (NIH). Shown is either the event count (FIGS. 20B and 20D), the percentage of low-proliferating (CFSE-high) cells (FIGS. 20A and 20C) or the MFI of CD62L (FIGS. 20F and 20H), CD127 (FIG. 20E) or GranzymeB vital CD4+ (FIG. 20G) and CD8+ T cells. Baseline values of samples containing only the anti-human CD3 (clone V9, huIgG1), resting human PBMC and NIH/3T3-huFAP clone 39 were substracted. Thus the enhancing effect of OX40 costimulation but not the effect of suboptimal anti-CD3 stimulation per se is shown here. Cells survived better, proliferated more and showed a stronger activated (CD62L and CD127 low) phenotype. Targeted bivalent constructs performed only slightly better than monovalent constructs. Clone 8H9 in a non-targeted huIgG1P329GLALA was not able to rescue suboptimal TCR stimulation in the absence of further crosslinking. In a FAP positive tumor micro environment this could lead to increased anti-tumor activity of T cells whereby systemic OX40 activation is avoided.
Figure 20B:
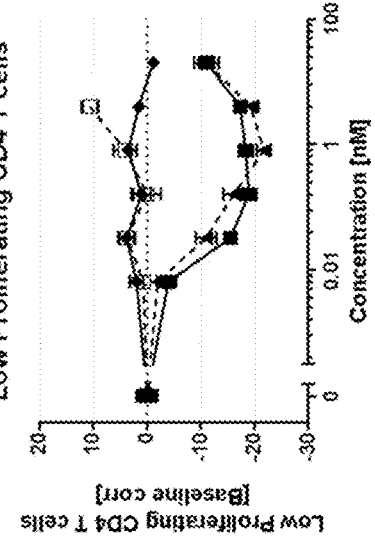
Figure 20C:
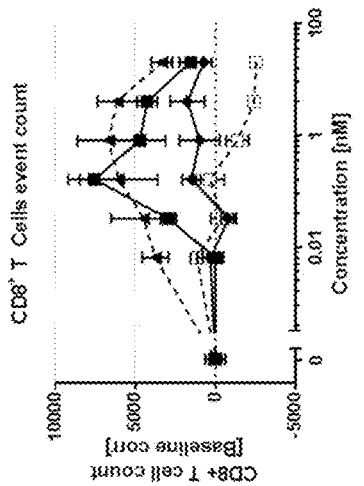
Figure 20D:
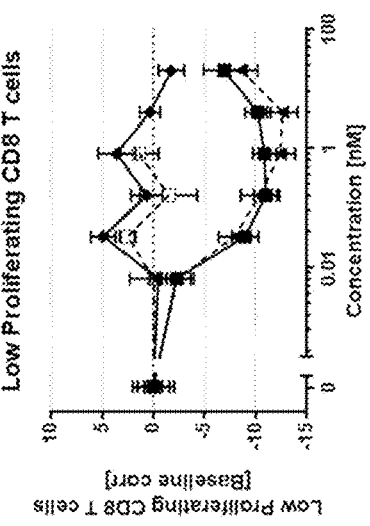
Figure 20E:
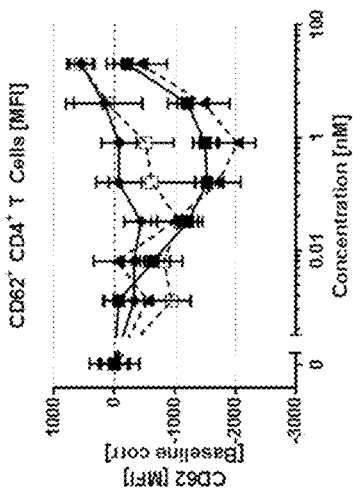
Figure 20F:
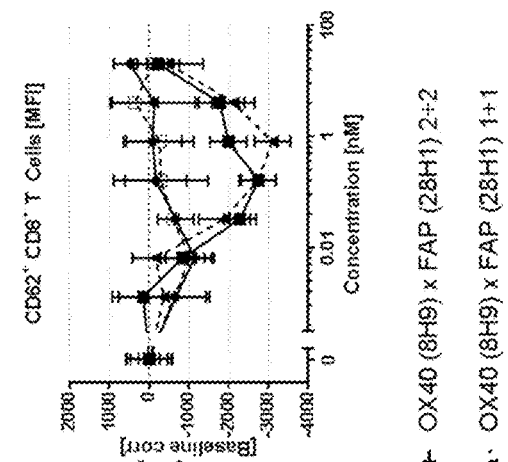
Figure 20G:
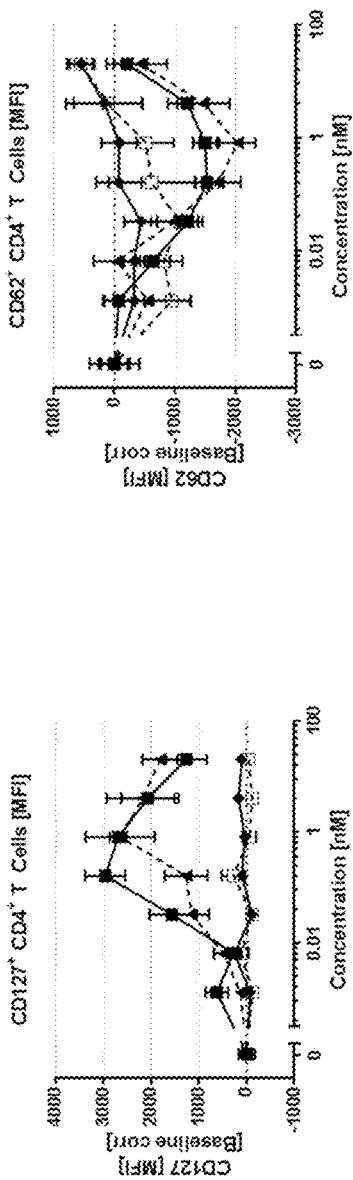
Figure 20H:
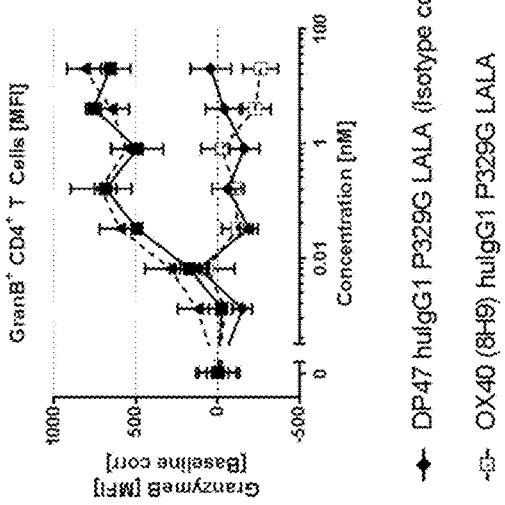

Co-stimulation with plate-immobilized bispecific anti-OX40 antigen binding molecules strongly enhanced suboptimal stimulation of pre-activated human CD4 T cells with plate-immobilized anti-human CD3 in a dose dependent manner (FIGS. 17A and 17B). T-cells proliferated stronger, showed a more mature phenotype with a higher percentage of CD127 low T cells, Tim-3 positive and OX40 positive activated cells (for clone 8H9 only shown for increase in granularity (SSC)). Monovalent binding (triangle symbol) to OX40 was thereby less efficient than bivalent binding (square symbol) to OX40, which showed the necessity of OX40 receptor oligomerization to fully activate the Ox40 signaling axis. Half-maximal changes in all analyzed parameters of T-cell activation were achieved at concentrations ranging from 3 to 2300 pM and are summarized for clone 1G4 in FIGS. 18A-18D and Table 35.

TABLE 35

EC$_{50}$ values of rescuing suboptimal TCR stimulation with plate-immobilized FAP targeted mono and bivalent anti-Ox40 (clone 1G4) constructs

| Clone | Format | EC$_{50}$ [nM] | +/−SEM |
|---|---|---|---|
| 1G4 | hu IgG1 | 0.37 | 0.03 |
|  | FAP 1 + 1 | 2.23 | 0.05 |
|  | FAP 2 + 2 | 0.75 | 0.16 |

5.3 Ox40 Mediated Costimulation of Suboptimally TCR Triggered Resting Human PBMC and Hypercrosslinking by Cell Surface FAP It was shown in Example 5.1 that addition of FAP$^+$ tumor cells can strongly increase the NFkB activity induced by FAP targeted mono and bivalent anti-OX40 constructs in human OX40 positive reporter cell lines by providing strong oligomerization of OX40 receptors. Likewise, we tested FAP targeted mono (1+1) and bivalent (2+1, 2+2) anti-OX40 constructs in the presence of NIH/3T3-huFAP clone 39 cells for their ability to rescue suboptimal TCR stimulation of resting human PBMC cells.

Human PBMC preparations contain (1) resting OX40 negative CD4$^+$ and CD8$^+$ T cells and (2) antigen presenting cells with various Fc-γ receptor molecules on their cell surface e.g. B cells and monocytes. Anti-human CD3 antibody of human IgG1 isotype can bind with its Fc part to the present Fc-γ receptor molecules and mediate a prolonged TCR activation on resting Ox40 negative CD4$^+$ and CD8$^+$ T cells. These cells then start to express OX40 within several hours. Functional agonistic compounds against OX40 can signal via the OX40 receptor present on activated CD8$^+$ and CD4$^+$ T cells and support TCR-mediated stimulation.

Resting CFSE-labeled human PBMC were stimulated for four to five days with a suboptimal concentration of anti-CD3 antibody in the presence of irradiated FAP$^+$ NIH/3T3-huFAP clone 39 cells and titrated anti-Ox40 constructs. Effects on T-cell survival and proliferation were analyzed through monitoring of total cell counts and CFSE dilution in living cells by flow cytometry. Additionally, cells were co-stained with fluorescently-labeled antibodies against T-cell activation and maturation marker CD25, Granzyme B, CD62L and CD127. In a second experiment, cells were co-stained with fluorescently-labeled antibodies against T-cell activation and maturation marker CD25, and Tim-3.

Mouse embryonic fibroblast NIH/3T3-huFAP clone 39 cells (Example 4.3.2.2) were harvested using cell dissociation buffer (Invitrogen, Cat.-No. 13151-014) for 10 minutes at 37° C. Cells were washed once with DPBS. NIH/3T3-huFAP clone 39 cells were cultured at a density of 0.2*10$^5$ cells per well in T cell media in a sterile 96-well round bottom adhesion tissue culture plate (TPP, Cat. No. 92097) over night at 37° C. and 5% CO$_2$ in an incubator (Hera Cell 150). The next day they were irradiated in an xRay irradiator using a dose of 4500 RAD to prevent later overgrowth of human PBMC by the tumor cell line.

Human PBMCs were isolated by ficoll density centrifugation and were labeled with CFSE as described in Example 2.1.2. Cells were added to each well at a density of 0.75*10$^5$ cells per well (first experiment) or 0.5*10$^5$ cells per well (second experiment). Anti-human CD3 antibody (clone V9, human IgG1) at a final concentration of [10 nM] and FAP targeted mono- and bivalent anti-OX40 antigen binding molecules were added at the indicated concentrations. Cells were activated for four to five days at 37° C. and 5% CO$_2$ in an incubator (Hera Cell 150). Then, cells were surface-stained with fluorescent dye-conjugated antibodies anti-human CD4 (clone RPA-T4, BioLegend, Cat.-No. 300532), CD8 (clone RPa-T8, BioLegend, Cat.-No. 3010441), CD25 (clone M-A251, BioLegend, Cat.-No. 356112), CD127 (clone A019D5, Biolegend, Cat.No. 351234) and CD62L (clone DREG 56, Biolegend, Ca.No. 304834) or Tim-3 (clone F38-E2E, Biolegend, Cat.No. 345012) for 30 min at 4° C. For permeabilizing the cell membrane, cell pellets were washed twice with FACS buffer, then resuspended in 50 µL/well freshly prepared FoxP3 Fix/Perm buffer (eBioscience, Cat.-No. 00-5123 and 00-5223) for 45 min at room temperature in the dark. After three times washing with Perm-Wash buffer (eBioscience, Cat.-No. 00-8333-56), cells were stained intracellular with 25 µL/well Perm-Wash Buffer containing anti-human Granzyme B antibody (clone GB-11, BD Bioscience, Cat. No. 561142) for 1 h at room temperature in the dark. Cells were resuspended in 85 µL/well FACS buffer and acquired using a 5-laser Fortessa flow cytometer (BD Bioscience with DIVA software).

Figure 21A:
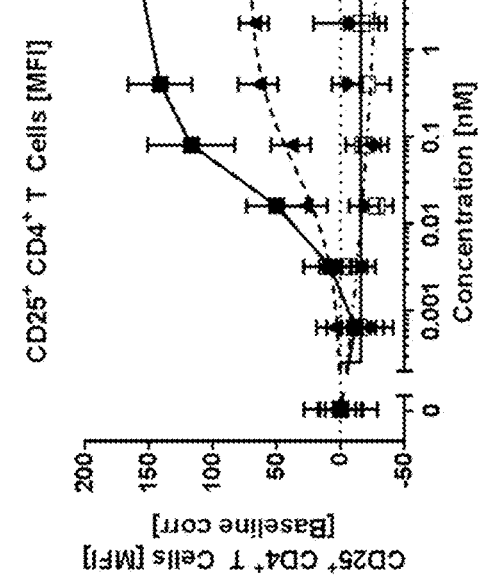
FIGS. 21A, 21B and 21C relate to the activation of resting human CD4 cell using surface immobilized FAP targeted mono and bivalent anti-OX40 (1G4) constructs. Costimulation with non-targeted anti-Ox40 (1G4) huIgG1 did not rescue suboptimally TCR stimulated CD4 and CD8 (data not shown) T cells. Hyper-crosslinking of the FAP targeted mono and bivalent anti-Ox40 constructs by the present NIH/3T3-huFAP clone 39 cells strongly promoted proliferation, survival (data not shown) and induced an enhanced activated phenotype in human CD4 cells. Shown is the MFI of CD25 expression on CD4 T cells and the percentage of CD25+ CD4 T cells. Baseline values of samples containing only the anti-human CD3 (clone V9, huIgG1), resting human PBMC and NIH/3T3-huFAP clone 39 were substracted. The agonistic effect of the compounds were quantified as area under the curve using the inbuilt function in GraphPad Prism and is shown for the three different anti-Ox40 (1G4) constructs. Targeted bivalent (2+2) constructs performed better than monovalent (1+1) constructs.
Figure 21B:
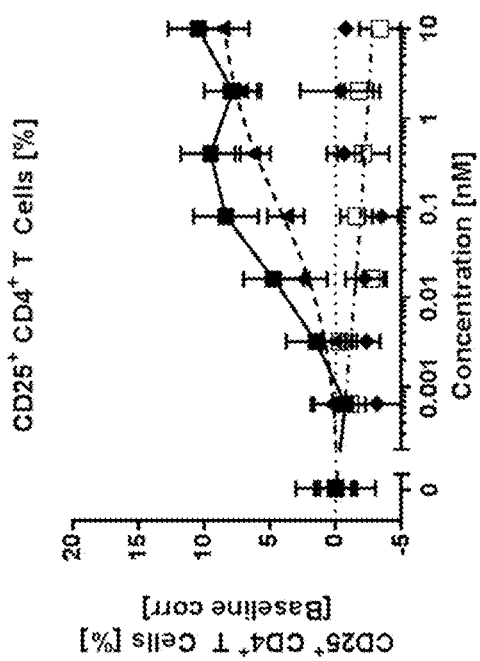
Figure 21C:
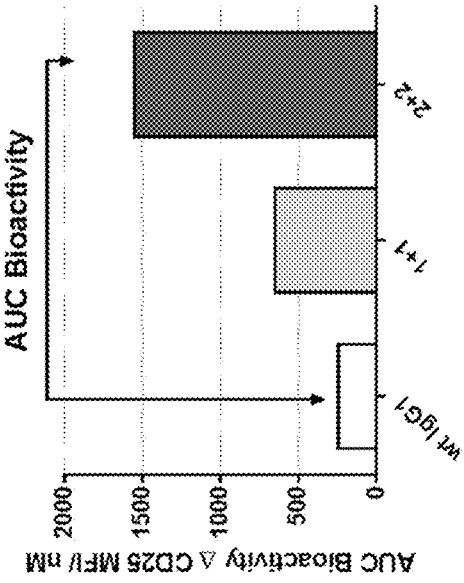
Figures 21D, 21E, 21F, 21G, 21H:
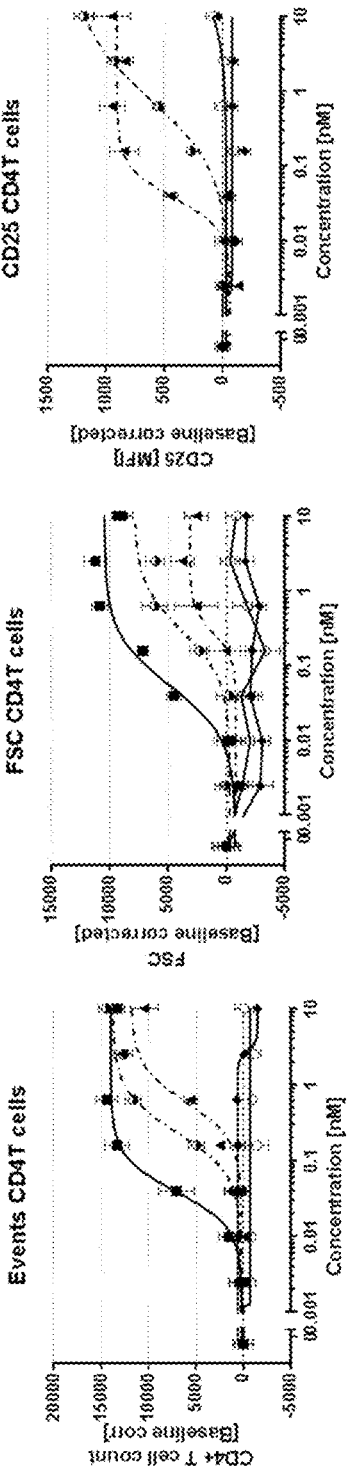

As shown in FIGS. 20A-20H, costimulation with non-targeted anti-Ox40 (8H9) huIgG1 P329GLALA (open square) did not rescue suboptimally TCR stimulated CD4 and CD8 T cells. Hyper-crosslinking of the FAP targeted mono (filled triangle) and bivalent (filled square) anti-OX40 constructs by the present NIH/3T3-huFAP clone 39 cells strongly promoted proliferation, survival and induced an enhanced activated phenotype in human CD4 and CD8 T cells. For high affinity clone 8H9 (FIGS. 20A-20H), monovalent and bivalent bispecific antigen binding molecule had a comparable ability to rescue suboptimal TCR stimulation. Both constructs showed again a peak activity at ~0.1-1 nM and a reduced response at higher concentration. Similar to the findings in the NFκB reporter cell line (FIGS. 16A-16M) this might be a consequence of competition for target binding between constructs that bind only to FAP or OX40 and those that bind simultaneously to both targets and provide thus the necessary cross-linking. This effect was less prominent when the low affinity clone 1G4 was tested in a FAP targeted monovalent versus a bivalent anti-OX40 construct (FIGS. 21A-21C). Here, the monovalent antibody was clearly inferior to the bivalent construct. This can be best appreciated when the agonistic capacity of each construct was quantified as area under the curve and plotted against each other (FIG. 21A-21C).

Figure 21P:
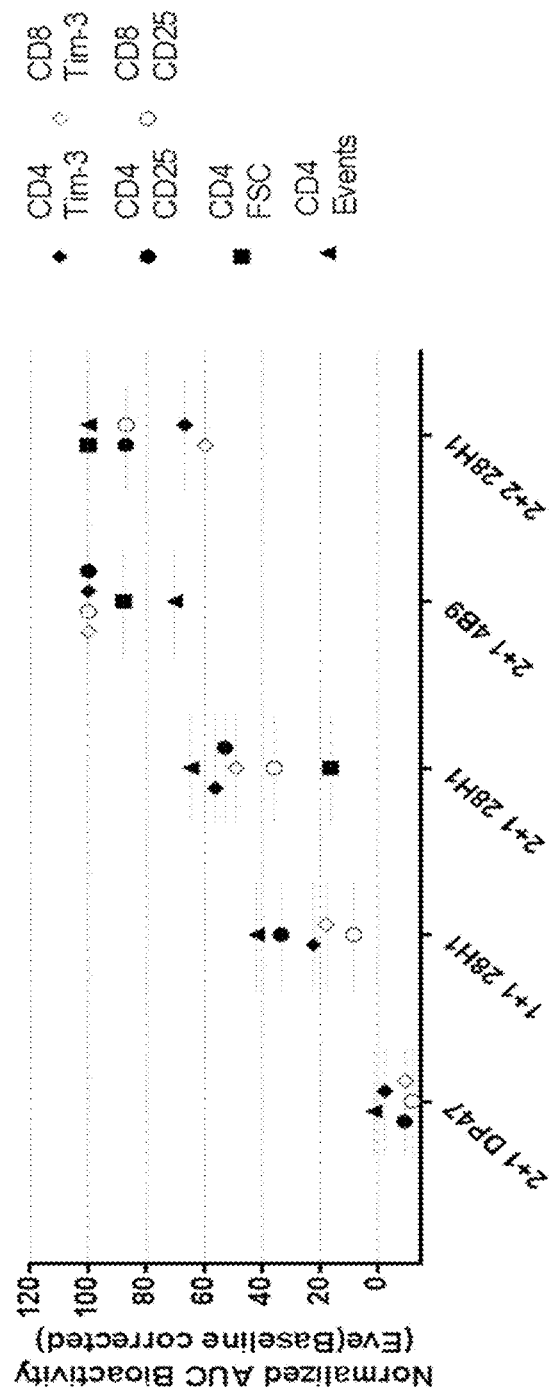

The data as obtained in the second experiment are shown in FIGS. 21D-21H and FIGS. 21J-21N, respectively. As shown in FIGS. 21D-21H, costimulation with non-targeted anti-Ox40 (49B4) 2+1 DP47 format (open circle) did not rescue suboptimally TCR stimulated CD4 and CD8 T cells. Hyper-crosslinking of the FAP targeted mono (filled triangle) and bivalent (filled square, semi-filled circle) anti-OX40 constructs by the present NIH/3T3-huFAP clone 39 cells strongly promoted survival and induced an enhanced activated phenotype in human CD4 and CD8 T cells. Monovalent anti-OX40 construct (1+1; filled triangle) was less able to rescue TCR stimulation than bivalent anti-OX40 targeting constructs (semi-filled circle, filled square). The bivalently to FAP binding 2+2 construct was already able at lower concentrations to rescue suboptimal TCR stimulation compared to the monovalently to FAP binding 2+1 constructs. In the 2+1 format the high affinity FAP binding clone 4B9 was clearly superior to the low affinity clone 28H1 (FIGS. 21J-21N). This suggests that the EC$_{50}$ values of the observed bioactivity were driven by the binding to FAP (2+2>2+1 (4B9)>2+1 (28H1)). This can be best appreciated when the agonistic capacity of each construct was quantified for the analyzed markers as area under the curve and plotted against each other (FIG. 21P).

5.4 Prevention of ADCC by Using an Human IgG1 P329GLALA Format

Antibodies of the human IgG1 class can induce antibody dependent cell death (ADCC) of antigen positive target cells by binding to Fcγ Receptors (FcγR) on ADCC competent cells, e.g. NK cells. Thus, an ADCC competent Ox40 antibody could mediate lysis of recently activated, Ox40+ T cells and diminish the pool of tumor-reactive T cells. The introduction of the IgG1P329GLALA mutation to the Fc part of the antibody prevents binding to FcγR (International Patent Appl. Publ. No. WO 2012/130831 A1), and thus ADCC in the presence of NK cells. However, binding to the FcN receptor is not altered to ensure IgG like pharmacokinetics of the antibody.

Selected clones were converted to a conventional human IgG1 format to test for their ability to induce ADCC. To test ADCC competence, PKh26 labeled OX40 positive tumor cells (HeLa_hOX40_NFkB_Luc1 reporter cell line) and freshly isolated NK cells were cocultured at an E to T ratio of 3 to 1 in the presence of a serial dilution row of anti OX40 antibodies (human IgG1 or human IgG1-P329GLALA format). The release of lactate dehydrogenase (LDH) and the amount of DAPI positive tumor cells was used to quantify NK cell mediated ADCC.

Briefly, HeLa_hOX40_NFkB_Luc1 cells (Example 3.1) were labeled using the PKH-26 Red Fluorescence Cell linker Kit (Sigma, Cat.-No. PKH26GL) as described in Example 2.3.2. PKH-26 labeled HeLa_hOx40_NFkB_luc1 cells were seeded at a density of $0.5*10^5$ cells per well in AIM V media (Gibco, Cat.No. 12055-09) in a sterile 96-well round bottom adhesion tissue culture plate (TPP, Cat. No. 92097) over night at 37° C. and 5% $CO_2$ in an incubator (Hera Cell 150). The next day, human PBMCs were isolated by ficoll density gradient centrifugation as described in Example 2.1.2. NK cell isolation was performed using the MACS negative NK cell isolation kit, human (Miltenyi Biotec, CatNo. 130-092-657) according to manufacturer instructions. NK cells were added at a density of $1.5*10^5$ cells per well in AIM V media resulting in an E to T ration of 3 to 1. Anti-OX40 antibodies (human IgG1 or human IgG1 P329GLALA) were added at the indicated concentrations and plates were incubated over night at 37° C. and 5% $CO_2$ in an incubator (Hera Cell 150). After 4 hrs, 100 μL supernatant was sampled for LDH analysis and media was replaced with fresh AIM-V media. LDH activity was quantified using the cytotoxicity detection kit—LDH (Roche, Cat.No. 11644793001) according to manufacturers's instructions on a SpectraMax M5/M5$^e$ (Molecular Devices) microplate reader (Filter 490 nm-650 nM, 1 ms integration time).

After 24 hours cells were detached using Trypsin. Cells were stained with fluorescently labeled anti-human CD56 (clone NCAM16.2, mouse IgG1 κ, BioLegend, Cat.-No. 562751), anti-human CD25 (clone MA251, mouse IgG1 κ, BioLegend, Cat.-No. 356116) and anti-human CD69 (clone FN50, mouse IgG1 κ, BioLegend, Cat.-No. 356116) incubated for 20 minutes at 4° C. in the dark. Plates were finally resuspended in 80 μL/well FACS-buffer containing 0.2 μg/mL DAPI (Santa Cruz Biotec, Cat. No. Sc-3598) and acquired the same day using 5-laser LSR-Fortessa (BD Bioscience with DIVA software).

Figure 22B:
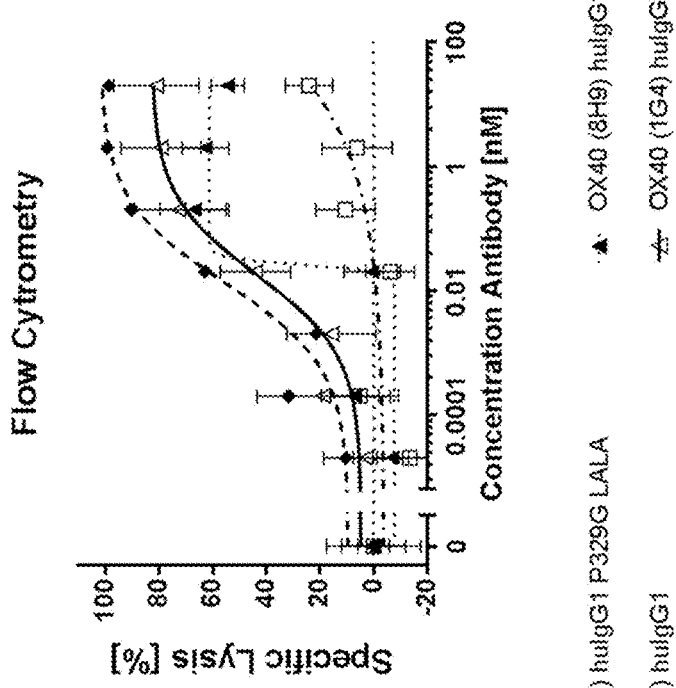
FIGS. 22A and 22B shows that anti-Ox40 antibodies containing human IgG1 Fc regions can induc lysis of OX40 positive cells. PkH26 labeled HeLa_hOx40_NFkB_Luc1 and freshly isolated NK cells were cocultured at an E to T ratio 3:1 for 24 hours in the presence of OX40 antibodies (human IgG1 and human IgG1 P329GLALA). The LDH content was analyzed after 4 hours using the cytotoxicity detection kit—LDH (Roche, Cat.No. 11644793001). After 24 hrs cells were stained with Dapi and were analyzed by flow cytometry. The percentage of Dapi positive dead cells was used to calculate specific lysis. Anti OX40 binders in a human IgG format bind to Fc receptors on NK cells and induce ADCC of OX40 positive target cells. Using the hu IgG1 P329GLALA format instead prevents ADCC of OX40 positive cells (e.g. recently activated T cells).
Figure 22A:
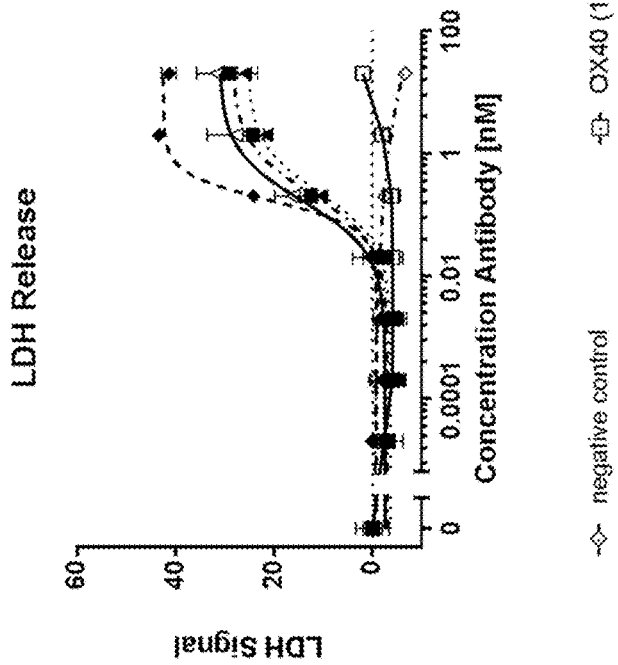
Figure 23A:
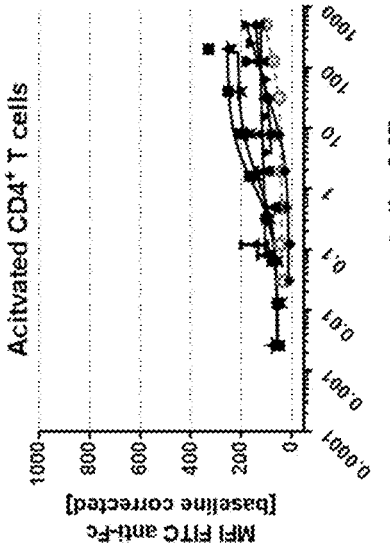
FIGS. 23A, 23B, 23C and 23D show the binding to resting and activated human T cells of four anti-human 4-1BB-specific clones transferred to a huIgG1 P329G LALA format (filled diamond: clone 25G7, filled square: clone 12B3, filled star: clone 11D5, pointing-up triangle: clone 9B11) and one anti-mouse 4-1BB specific clone 20G2 transferred to a huIgG1 P329G LALA format (pointing down triangle). As negative control a non-4-1BB-specific clone DP47 huIgG1 P329G LALA antibody was used (open grey circle). The upper panels show binding to resting CD4+ T cells (FIG. 23A) and activated CD4+ T cells (FIG. 23B), whereas the lower panels show binding to resting CD8+ T cells (FIG. 23C) and activated CD8+ T cells (FIG. 23D). The binding is characterized by plotting the median of fluorescence (MFI) of FITC-labeled or PE-labeled anti-human IgG Fcγ-specific goat IgG F(ab')$_2$ fragment that is used as secondary detection antibody versus the concentration in nM of the tested primary anti-4-1BB-binding huIgG1 P329G LALA antibodies. MFI was measured by flow cytometry and baseline corrected by subtracting the MFI of the blank control (no primary antibody).
Figure 23C:
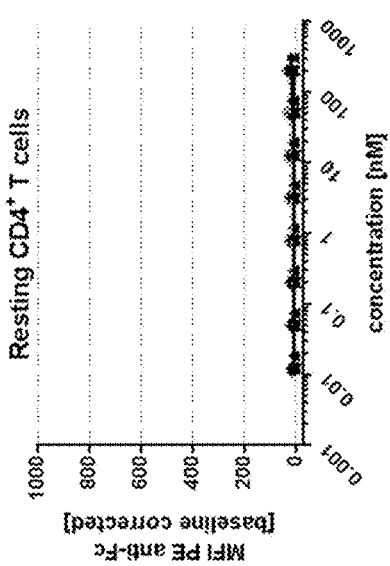
Figure 23B:
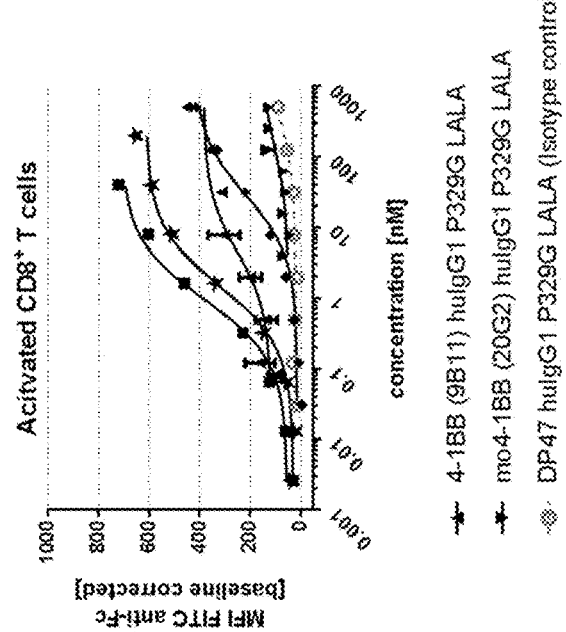
Figure 23D:
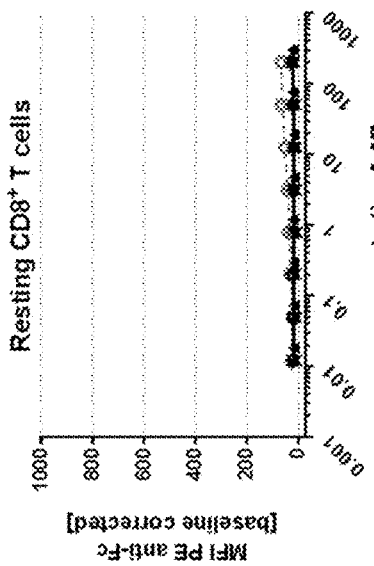

All Ox40 antibodies in an ADCC competent human IgG1 format were able to induce lysis of Ox40 positive cells to a similar extent then an ADCC competent reference antibody (GA201) against EGFR. Clones in an IgGP329GLALA format did not mediate ADCC (see FIGS. 22A and 22B).

The introduction of the IgG1 P329GLALA mutation to the Fc part of our targeted formats prevents binding to FcγR (International Patent Appl. Publ. No. WO 2012/130831 A1), and thus ADCC in the presence of NK cells. However, binding to the FcN receptor is not altered to ensure IgG like pharmacokinetics of the antibody. In contrast to already existing OX40 antibodies the hypercrosslinking that is necessary for optimal agonistic OX40 signaling was provided in the bispecific antibodies of the invention by binding to FAP positive tumor cells or fibroblasts. FAP positivity, either on tumor associated fibroblasts or on tumor cells themselves, is reported for many tumor indications. Thus, the bispecific format has the potential for strong OX40 mediated agonism in the tumor microenvironment in the absence of systemic activation, which might prevent immune related toxicities. Contrary to conventional anti-OX40 antibodies the bispecific antigen binding molecules of the invention do not induce ADCC of recently activated OX40 positive effector T cells. Thus, the bispecific antibodies may have the potential to reactivate a preexisting, but suppressed adaptive immune response against the tumor cells and can be effectively used for the treatment of cancer patients.

Example 6

Generation of 4-1BB Antibodies and Tool Binders 6.1 Preparation, Purification and Characterization of Antigens and Screening Tools for the Generation of Novel 4-1BB Binders by Phage Display DNA sequences encoding the ectodomains of human, mouse or cynomolgus 4-1BB (Table 36) were subcloned in frame with the human IgG1 heavy chain CH2 and CH3 domains on the knob (Merchant et al., 1998). An AcTEV protease cleavage site was introduced between an antigen ectodomain and the Fc of human IgG1. An Avi tag for directed biotinylation was introduced at the C-terminus of the antigen-Fc knob. Combination of the antigen-Fc knob chain containing the S354C/T366W mutations, with a Fc hole chain containing the Y349C/T366S/L368A/Y407V mutations allows generation of a heterodimer which includes a single copy of 4-1BB ectodomain containing chain, thus creating a monomeric form of Fc-linked antigen (FIG. 1A). Table 37 shows the cDNA and amino acid sequences of the antigen Fc-fusion constructs.

TABLE 36

Amino acid numbering of antigen ectodomains (ECD) and their origin

| SEQ ID NO: | Construct | Origin | ECD |
|---|---|---|---|
| 39 | human 4-1BB ECD | Synthetized according to Q07011 | aa 24-186 |
| 240 | cynomolgus 4-1BB ECD | isolated from cynomolgus blood | aa 24-186 |
| 241 | murine 4-1BB ECD | Synthetized according to P20334 | aa 24-187 |

TABLE 37 cDNA and amino acid sequences of monomeric antigen Fc(kih) fusion molecules (produced by combination of one Fc hole chain with one antigen Fc knob chain)

| SEQ ID NO: | Antigen | Sequence |
|---|---|---|
| 124 | Nucleotide sequence Fc hole chain | see Table 2 |
| 242 | Nucleotide sequence human 4-1BB antigen Fc knob chain | CTGCAGGACCCCTGCAGCAACTGCCCTGCCGGCACCTTCT GCGACAACAACCGGAACCAGATCTGCAGCCCCTGCCCCC CCAACAGCTTCAGCTCTGCCGGCGGACAGCGGACCTGCG ACATCTGCAGACAGTGCAAGGGCGTGTTCAGAACCCGGA AAGAGTGCAGCAGCACCAGCAACGCCGAGTGCGACTGCA CCCCCGGCTTCCATTGTCTGGGAGCCGGCTGCAGCATGTG CGAGCAGGACTGCAAGCAGGGCCAGGAACTGACCAAGA AGGGCTGCAAGGACTGCTGCTTCGGCACCTTCAACGACC AGAAGCGGGGCATCTGCCGGCCCTGGACCAACTGTAGCC TGGACGGCAAGAGCGTGCTGGTCAACGGCACCAAAGAAC GGGACGTCGTGTGCGGCCCCAGCCCTGCTGATCTGTCTCC TGGGGCCAGCAGCGTGACCCCTCCTGCCCCTGCCAGAGA GCCTGGCCACTCTCCTCAGGTCGACGAACAGTTATATTTT CAGGGCGGCTCACCCAAATCTGCAGACAAAACTCACACA TGCCCACCGTGCCCAGCACCTGAACTCCTGGGGGGACCGT CAGTCTTCCTCTTCCCCCCAAAACCCAAGGACACCCTCAT GATCTCCCGGACCCCTGAGGTCACATGCGTGGTGGTGGAC GTGAGCCACGAAGACCCTGAGGTCAAGTTCAACTGGTAC GTGGACGGCGTGGAGGTGCATAATGCCAAGACAAAGCCG CGGGAGGAGCAGTACAACAGCACGTACCGTGTGGTCAGC GTCCTCACCGTCCTGCACCAGGACTGGCTGAATGGCAAG GAGTACAAGTGCAAGGTCTCCAACAAAGCCCTCCCAGCC CCCATCGAGAAAACCATCTCCAAAGCCAAAGGGCAGCCC CGAGAACCACAGGTGTACACCCTGCCCCCATGCCGGGAT GAGCTGACCAAGAACCAGGTCAGCCTGTGGTGCCTGGTC AAAGGCTTCTATCCCAGCGACATCGCCGTGGAGTGGGAG AGCAATGGGCAGCCGGAGAACAACTACAAGACCACGCCT CCCGTGCTGGACTCCGACGGCTCCTTCTTCCTCTACAGCA AGCTCACCGTGGACAAGAGCAGGTGGCAGCAGGGGAACG TCTTCTCATGCTCCGTGATGCATGAGGCTCTGCACAACCA CTACACGCAGAAGAGCCTCTCCCTGTCTCCGGGTAAATCC GGAGGCCTGAACGACATCTTCGAGGCCCAGAAGATTGAA TGGCACGAG |
| 243 | Nucleotide sequence cynomolgus 4-1BB antigen Fc knob chain | TTGCAGGATCTGTGTAGTAACTGCCCCAGCTGGTACATTCT GTGATAATAACAGGAGTCAGATTTGCAGTCCCTGTCCTCC AAATAGTTTCTCCAGCGCAGGTGGACAAAGGACCTGTGA CATATGCAGGCAGTGTAAAGGTGTTTTCAAGACCAGGAA GGAGTGTTCCTCCACCAGCAATGCAGAGTGTGACTGCATT TCAGGGTATCACTGCCTGGGGGCAGAGTGCAGCATGTGT GAACAGGATTGTAAACAAGGTCAAGAATTGACAAAAAAA GGTTGTAAAGACTGTTGCTTTGGGACATTTAATGACCAGA AACGTGGCATCTGTCGCCCCTGGACAAACTGTTCTTTGGA TGGAAAGTCTGTGCTTGTGAATGGGACGAAGGAGAGGGA CGTGGTCTGCGGACCATCTCCAGCCGACCTCTCTCCAGGA GCATCCTCTGCGACCCCGCCTGCCCCTGCGAGAGAGCCAG GACACTCTCCGCAGGTCGACGAACAGTTATATTTTCAGGG CGGCTCACCCAAATCTGCAGACAAAACTCACACATGCCC ACCGTGCCCAGCACCTGAACTCCTGGGGGGACCGTCAGT CTTCCTCTTCCCCCCAAAACCCAAGGACACCCTCATGATC TCCCGGACCCCTGAGGTCACATGCGTGGTGGTGGACGTG AGCCACGAAGACCCTGAGGTCAAGTTCAACTGGTACGTG GACGGCGTGGAGGTGCATAATGCCAAGACAAAGCCGCGG GAGGAGCAGTACAACAGCACGTACCGTGTGGTCAGCGTC CTCACCGTCCTGCACCAGGACTGGCTGAATGGCAAGGAG TACAAGTGCAAGGTCTCCAACAAAGCCCTCCCAGCCCCC ATCGAGAAAACCATCTCCAAAGCCAAAGGGCAGCCCCGA GAACCACAGGTGTACACCCTGCCCCCATGCCGGGATGAG CTGACCAAGAACCAGGTCAGCCTGTGGTGCCTGGTCAAA GGCTTCTATCCCAGCGACATCGCCGTGGAGTGGGAGAGC AATGGGCAGCCGGAGAACAACTACAAGACCACGCCTCCC GTGCTGGACTCCGACGGCTCCTTCTTCCTCTACAGCAAGC TCACCGTGGACAAGAGCAGGTGGCAGCAGGGGAACGTCT TCTCATGCTCCGTGATGCATGAGGCTCTGCACAACCACTA CACGCAGAAGAGCCTCTCCCTGTCTCCGGGTAAATCCGGA GGCCTGAACGACATCTTCGAGGCCCAGAAGATTGAATGG CACGAG |
| 244 | Nucleotide sequence | GTGCAGAACAGCTGCGACAACTGCCAGCCCGGCACCTTC TGCCGGAAGTACAACCCCGTGTGCAAGAGCTGCCCCCCC |

TABLE 37-continued cDNA and amino acid sequences of monomeric antigen Fc(kih) fusion molecules (produced by combination of one Fc hole chain with one antigen Fc knob chain)

| SEQ ID NO: | Antigen | Sequence |
|---|---|---|
| | murine 4-1BB antigen Fc knob chain | AGCACCTTCAGCAGCATCGGCGGCCAGCCCAACTGCAAC ATCTGCAGAGTGTGCGCCGGCTACTTCCGGTTCAAGAAGT TCTGCAGCAGCACCCACAACGCCGAGTGCGAGTGCATCG AGGGCTTCCACTGCCTGGGCCCCCAGTGCACCAGATGCG AGAAGGACTGCAGACCCGGCCAGGAACTGACCAAGCAGG GCTGTAAGACCTGCAGCCTGGGCACCTTCAACGACCAGA ACGGGACCGGCGTGTGCCGGCCTTGGACCAATTGCAGCC TGGACGGGAGAAGCGTGCTGAAAACCGGCACCACCGAGA AGGACGTCGTGTGCGGCCCTCCCGTGGTGTCCTTCAGCCC TAGCACCACCATCAGCGTGACCCCTGAAGGCGGCCCTGG CGGACACTCTCTGCAGGTCCTGGTCGACGAACAGTTATAT TTTCAGGGCGGCTCACCCAAATCTGCAGACAAAACTCAC ACATGCCCACCGTGCCCAGCACCTGAACTCCTGGGGGGA CCGTCAGTCTTCCTCTTCCCCCCAAAACCCAAGGACACCC TCATGATCTCCCGGACCCCTGAGGTCACATGCGTGGTGGT GGACGTGAGCCACGAAGACCCTGAGGTCAAGTTCAACTG GTACGTGGACGGCGTGGAGGTGCATAATGCCAAGACAAA GCCGCGGGAGGAGCAGTACAACAGCACGTACCGTGTGGT CAGCGTCCTCACCGTCCTGCACCAGGACTGGCTGAATGGC AAGGAGTACAAGTGCAAGGTCTCCAACAAAGCCCTCCCA GCCCCCATCGAGAAAACCATCTCCAAAGCCAAAGGGCAG CCCCGAGAACCACAGGTGTACACCCTGCCCCCATGCCGG GATGAGCTGACCAAGAACCAGGTCAGCCTGTGGTGCCTG GTCAAAGGCTTCTATCCCAGCGACATCGCCGTGGAGTGG GAGAGCAATGGGCAGCCGGAGAACAACTACAAGACCAC GCCTCCCGTGCTGGACTCCGACGGCTCCTTCTTCCTCTAC AGCAAGCTCACCGTGGACAAGAGCAGGTGGCAGCAGGGG AACGTCTTCTCATGCTCCGTGATGCATGAGGCTCTGCACA ACCACTACACGCAGAAGAGCCTCTCCCTGTCTCCGGGTAA ATCCGGAGGCCTGAACGACATCTTCGAGGCCCAGAAGAT TGAATGGCACGAG |
| 128 | Fc hole chain | see Table 2 |
| 245 | human 4-1BB antigen Fc knob chain | LQDPCSNCPAGTFCDNNRNQICSPCPPNSFSSAGGQRTCDIC RQCKGVFRTRKECSSTSNAECDCTPGFHCLGAGCSMCEQDC KQGQELTKKGCKDCCFGTFNDQKRGICRPWTNCSLDGKSV LVNGTKERDVVCGPSPADLSPGASSVTPPAPAREPGHSPQVD EQLYFQGGSPKSADKTHTCPPCPAPELLGGPSVFLFPPKPKD TLMISRTPEVTCVVVDVSHEDPEVKFNWYVDGVEVHNAKT KPREEQYNSTYRVVSVLTVLHQDWLNGKEYKCKVSNKALP APIEKTISKAKGQPREPQVYTLPPCRDELTKNQVSLWCLVKG FYPSDIAVEWESNGQPENNYKTTPPVLDSDGSFFLYSKLTVD KSRWQQGNVFSCSVMHEALHNHYTQKSLSLSPGKGGGLNDI FEAQKIEWHE |
| 246 | cynomolgus 4-1BB antigen Fc knob chain | LQDLCSNCPAGTFCDNNRSQICSPCPPNSFSSAGGQRTCDICR QCKGVFKTRKECSSTSNAECDCISGYHCLGAECSMCEQDCK QGQELTKKGCKDCCFGTFNDQKRGICRPWTNCSLDGKSVL VNGTKERDVVCGPSPADLSPGASSATPPAPAREPGHSPQVDE QLYFQGGSPKSADKTHTCPPCPAPELLGGPSVFLFPPKPKDT LMISRTPEVTCVVVDVSHEDPEVKFNWYVDGVEVHNAKTK PREEQYNSTYRVVSVLTVLHQDWLNGKEYKCKVSNKALPA PIEKTISKAKGQPREPQVYTLPPCRDELTKNQVSLWCLVKGF YPSDIAVEWESNGQPENNYKTTPPVLDSDGSFFLYSKLTVDK SRWQQGNVFSCSVMHEALHNHYTQKSLSLSPGKSGGLNDIF EAQKIEWHE |
| 247 | murine 4-1BB antigen Fc knob chain | VQNSCDNCQPGTFCRKYNPVCKSCPPSTFSSIGGQPNCNICR VCAGYFRFKKFCSSTHNAECECIEGFHCLGPQCTRCEKDCRP GQELTKQGCKTCSLGTFNDQNGTGVCRPWTNCSLDGRSVL KTGTTEKDVVCGPPVVSFSPSTTISVTPEGGPGGHSLQVLVD EQLYFQGGSPKSADKTHTCPPCPAPELLGGPSVFLFPPKPKD TLMISRTPEVTCVVVDVSHEDPEVKFNWYVDGVEVHNAKT KPREEQYNSTYRVVSVLTVLHQDWLNGKEYKCKVSNKALP APIEKTISKAKGQPREPQVYTLPPCRDELTKNQVSLWCLVKG FYPSDIAVEWESNGQPENNYKTTPPVLDSDGSFFLYSKLTVD KSRWQQGNVFSCSVMHEALHNHYTQKSLSLSPGKSGGLNDI FEAQKIEWHE |

All 4-1BB-Fc-fusion molecule encoding sequences were cloned into a plasmid vector, which drives expression of the insert from an MPSV promoter and contains a synthetic polyA signal sequence located at the 3' end of the CDS. In addition, the vector contains an EBV OriP sequence for episomal maintenance of the plasmid.

For preparation of the biotinylated monomeric antigen/Fc fusion molecules, exponentially growing suspension HEK293 EBNA cells were co-transfected with three vectors encoding the two components of fusion protein (knob and hole chains) as well as BirA, an enzyme necessary for the biotinylation reaction. The corresponding vectors were used at a 2:1:0.05 ratio ("antigen ECD-AcTEV-Fc knob":"Fc hole":"BirA").

For protein production in 500 ml shake flasks, 400 million HEK293 EBNA cells were seeded 24 hours before transfection. For transfection cells were centrifuged for 5 minutes at 210 g, and the supernatant was replaced by pre-warmed CD CHO medium. Expression vectors were resuspended in 20 mL of CD CHO medium containing 200 μg of vector DNA. After addition of 540 μL of polyethylenimine (PEI), the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% $CO_2$ atmosphere. After the incubation, 160 mL of F17 medium was added and cells were cultured for 24 hours. The production medium was supplemented with 5 μM kifunensine. One day after transfection, 1 mM valproic acid and 7% Feed were added to the culture. After 7 days of culturing, the cell supernatant was collected by spinning down cells for 15 min at 210 g. The solution was sterile filtered (0.22 μm filter), supplemented with sodium azide to a final concentration of 0.01% (w/v), and kept at 4° C.

Secreted proteins were purified from cell culture supernatants by affinity chromatography using Protein A, followed by size exclusion chromatography. For affinity chromatography, the supernatant was loaded on a HiTrap ProteinA HP column (CV=5 mL, GE Healthcare) equilibrated with 40 mL 20 mM sodium phosphate, 20 mM sodium citrate pH 7.5. Unbound protein was removed by washing with at least 10 column volumes of 20 mM sodium phosphate, 20 mM sodium citrate, 0.5 M sodium chloride containing buffer (pH 7.5). The bound protein was eluted using a linear pH-gradient of sodium chloride (from 0 to 500 mM) created over 20 column volumes of 20 mM sodium citrate, 0.01% (v/v) Tween-20, pH 3.0. The column was then washed with 10 column volumes of 20 mM sodium citrate, 500 mM sodium chloride, 0.01% (v/v) Tween-20, pH 3.0. The pH of collected fractions was adjusted by adding 1/40 (v/v) of 2M Tris, pH8.0. The protein was concentrated and filtered prior to loading on a HiLoad Superdex 200 column (GE Healthcare) equilibrated with 2 mM MOPS, 150 mM sodium chloride, 0.02% (w/v) sodium azide solution of pH 7.4.

6.2 Selection of 4-1BB-Specific 12B3, 25G7, 11D5, 9B11 and 20G2 Antibodies from Generic F(Ab) Libraries The antibodies 11D5, 9B11, and 12B3 with specificity for human and cynomolgus 4-1BB were selected from a generic phage-displayed antibody library (DP88-4) in the Fab format. From the same library, an additional antibody, clone 20G2, with reactivity to murine 4-1BB was selected as well. This library was constructed on the basis of human germline genes using the V-domain pairing Vk1_5 (kappa light chain) and VH1_69 (heavy chain) comprising randomized sequence space in CDR3 of the light chain (L3, 3 different lengths) and CDR3 of the heavy chain (H3, 3 different lengths). Library generation was performed by assembly of 3 PCR-amplified fragments applying splicing by overlapping extension (SOE) PCR. Fragment 1 comprises the 5' end of the antibody gene including randomized L3, fragment 2 is a central constant fragment spanning from L3 to H3 whereas fragment 3 comprises randomized H3 and the 3' portion of the antibody gene. The following primer combinations were used to generate these library fragments for DP88-4 library: fragment 1 (forward primer LMB3 combined with reverse primers Vk1_5_L3r_S or Vk1_5_L3r_SY or Vk1_5_L3r_SPY), fragment 2 (forward primer RJH31 combined with reverse primer RJH32) and fragment 3 (forward primers DP88-v4-4 or DP88-v4-6 or DP88-v4-8 combined with reverse primer fdseqlong), respectively. PCR parameters for production of library fragments were 5 min initial denaturation at 94° C., 25 cycles of 1 min 94° C., 1 min 58° C., 1 min 72° C. and terminal elongation for 10 min at 72° C. For assembly PCR, using equimolar ratios of the gel-purified single fragments as template, parameters were 3 min initial denaturation at 94° C. and 5 cycles of 30 s 94° C., 1 min 58° C., 2 min 72° C. At this stage, outer primers (LMB3 and fdseqlong) were added and additional 20 cycles were performed prior to a terminal elongation for 10 min at 72° C. After assembly of sufficient amounts of full length randomized Fab constructs, they were digested NcoI/NheI and ligated into similarly treated acceptor phagemid vector. Purified ligations were used for ~60 transformations into electrocompetent E. coli TG1. Phagemid particles displaying the Fab library were rescued and purified by PEG/NaCl purification to be used for selections. These library construction steps were repeated three times to obtain a final library size of $4.4 \times 10^9$. Percentages of functional clones, as determined by C-terminal tag detection in dot blot, were 92.6% for the light chain and 93.7% for the heavy chain, respectively.

The antibody 25G7 with specificity for human and cynomolgus 4-1BB was selected from a generic phage-displayed antibody library (λ-DP47) in the Fab format. This library was constructed on the basis of human germline genes using the V-domain pairing Vl3_19 (lambda light chain) and VH3_23 (heavy chain) comprising randomized sequence space in CDR3 of the light chain (L3, 3 different lengths) and CDR3 of the heavy chain (H3, 3 different lengths). Library generation was performed by assembly of 3 PCR-amplified fragments applying splicing by overlapping extension (SOE) PCR. Fragment 1 comprises the 5' end of the antibody gene including randomized L3, fragment 2 is a central constant fragment spanning from L3 to H3 whereas fragment 3 comprises randomized H3 and the 3' portion of the antibody gene. The following primer combinations were used to generate these library fragments for λ-DP47 library: fragment 1 (forward primer LMB3 combined with reverse primers Vl_3_19_L3r_V or Vl_3_19_L3r_HV or Vl_3_19_L3r_HLV), fragment 2 (forward primer RJH80 combined with reverse primer MS63) and fragment 3 (forward primers DP47-v4-4 or DP47-v4-6 or DP47-v4-8 combined with reverse primer fdseqlong), respectively. PCR parameters for production of library fragments were 5 min initial denaturation at 94° C., 25 cycles of 1 min 94° C., 1 min 58° C., 1 min 72° C. and terminal elongation for 10 min at 72° C. For assembly PCR, using equimolar ratios of the gel-purified single fragments as template, parameters were 3 min initial denaturation at 94° C. and 5 cycles of 30 s 94° C., 1 min 58° C., 2 min 72° C. At this stage, outer primers (LMB3 and fdseqlong) were added and additional 20 cycles were performed prior to a terminal elongation for 10 min at 72° C. After assembly of sufficient amounts of full length randomized Fab constructs, they were digested NcoI/NheI and ligated into similarly treated acceptor phagemid vector. Purified ligations were used for ~60 transformations into electrocompetent E. coli TG1. Phagemid particles displaying the Fab library were rescued and purified by PEG/NaCl purification to be used for selections. A final library size of $9.5 \times 10^9$ was obtained. Percentages of functional clones, as determined by C-terminal tag detection in dot blot, were 81.1% for the light chain and 83.2% for the heavy chain, respectively.

Table 38 shows the sequence of generic phage-displayed antibody library (DP88-4), Table 39 provides cDNA and amino acid sequences of library DP88-4 germline template and Table 40 shows the Primer sequences used for generation of DP88-4 germline template.

TABLE 38

Sequence of generic phage-displayed antibody library (DP88-4)

| SEQ ID NO: | Description | Sequence |
|---|---|---|
| 132 | nucleotide sequence of pRJH33 library template DP88-4 library; complete Fab coding region comprising PelB leader sequence + Vk1_5 kappa V-domain + CL constant domain for light chain and PelB + VH1_69 V-domain + CH1 constant domain for heavy chain including tags | TGAAATACCTATTGCCTACGGCAGCCGCTGGATTGTTATTACTCG CGGCCCAGCCGGCCATGGCCGACATCCAGATGACCCAGTCTCCT TCCACCCTGTCTGCATCTGTAGGAGACCGTGTCACCATCACTTGC CGTGCCAGTCAGAGTATTAGTAGCTGGTTGGCCTGGTATCAGCA GAAACCAGGGAAAGCCCCTAAGCTCCTGATCTATGATGCCTCCA GTTTGGAAAGTGGGGTCCCATCACGTTTCAGCGGCAGTGGATCC GGGACAGAATTCACTCTCACCATCAGCAGCTTGCAGCCTGATGA TTTTGCAACTTATTACTGCCAACAGTATAATAGTTATTCTACGTT TGGCCAGGGCACCAAAGTCGAGATCAAGCGTACGGTGGCTGCA CCATCTGTCTTCATCTTCCCGCCATCTGATGAGCAGTTGAAATCT GGAACTGCCTCTGTTGTGTGCCTGCTGAATAACTTCTATCCCAGA GAGGCCAAAGTACAGTGGAAGGTGGATAACGCCCTCCAATCGG GTAACTCCCAGGAGAGTGTCACAGAGCAGGACAGCAAGGACAG CACCTACAGCCTCAGCAGCACCCTGACGCTGAGCAAAGCAGACT ACGAGAAACACAAAGTCTACGCCTGCGAAGTCACCCATCAGGG CCTGAGCTCGCCCGTCACAAAGAGCTTCAACAGGGGAGAGTGTG GAGCCGCAGAACAAAAACTCATCTCAGAAGAGGATCTGAATGG AGCCGCAGACTACAAGGACGACGACGACAAGGGTGCCGCATAA TAAGGCGCGCCAATTCTATTTCAAGGAGACAGTCATATGAAATA CCTGCTGCCGACCGCTGCTGCTGGTCTGCTGCTCCTCGCTGCCCA GCCGGCGATGGCCCAGGTGCAATTGGTGCAGTCTGGGGCTGAGG TGAAGAAGCCTGGGTCCTCGGTGAAGGTCTCCTGCAAGGCCTCC GGAGGCACATTCAGCAGCTACGCTATAAGCTGGGTGCGACAGGC CCCTGGACAAGGGCTCGAGTGGATGGGAGGGATCATCCCTATCT TTGGTACAGCAAACTACGCACAGAAGTTCCAGGGCAGGGTCACC ATTACTGCAGACAAATCCACGAGCACAGCCTACATGGAGCTGAG CAGCCTGAGATCTGAGGACACCGCCGTGTATTACTGTGCGAGAC TATCCCCAGGCGGTTACTATGTTATGGATGCCTGGGGCCAAGGG ACCACCGTGACCGTCTCCTCAGCTAGCACCAAAGGCCCATCGGT CTTCCCCCTGGCACCCTCCTCCAAGAGCACCTCTGGGGGCACAG CGGCCCTGGGCTGCCTGGTCAAGGACTACTTCCCCGAACCGGTG ACGGTGTCGTGGAACTCAGGCGCCCTGACCAGCGGCGTGCACAC CTTCCCGGCTGTCCTACAGTCCTCAGGACTCTACTCCCTCAGCAG CGTGGTGACCGTGCCCTCCAGCAGCTTGGGCACCCAGACCTACA TCTGCAACGTGAATCACAAGCCCAGCAACACCAAAGTGGACAA GAAAGTTGAGCCCAAATCTTGTGACGCGGCCGCAAGCACTAGTG CCCATCACCATCACCATCACGCCGCGGCA |

TABLE 39 cDNA and amino acid sequences of library DP88-4 germline template

| SEQ ID NO: | Description | Sequence |
|---|---|---|
| 133 | nucleotide sequence of Fab light chain Vk1_5 | GACATCCAGATGACCCAGTCTCCTTCCACCCTGTCTGC ATCTGTAGGAGACCGTGTCACCATCACTTGCCGTGCCA GTCAGAGTATTAGTAGCTGGTTGGCCTGGTATCAGCAG AAACCAGGGAAAGCCCCTAAGCTCCTGATCTATGATGC CTCCAGTTTGGAAAGTGGGGTCCCATCACGTTTCAGCG GCAGTGGATCCGGGACAGAATTCACTCTCACCATCAGC AGCTTGCAGCCTGATGATTTTGCAACTTATTACTGCCA ACAGTATAATAGTTATTCTACGTTTGGCCAGGGCACCA AAGTCGAGATCAAGCGTACGGTGGCTGCACCATCTGTC TTCATCTTCCCGCCATCTGATGAGCAGTTGAAATCTGG AACTGCCTCTGTTGTGTGCCTGCTGAATAACTTCTATCC CAGAGAGGCCAAAGTACAGTGGAAGGTGGATAACGCC CTCCAATCGGGTAACTCCCAGGAGAGTGTCACAGAGC AGGACAGCAAGGACAGCACCTACAGCCTCAGCAGCAC CCTGACGCTGAGCAAAGCAGACTACGAGAAACACAAA |

TABLE 39-continued cDNA and amino acid sequences of library DP88-4 germline template

| SEQ ID NO: | Description | Sequence |
|---|---|---|
| | | GTCTACGCCTGCGAAGTCACCCATCAGGGCCTGAGCTC<br>GCCCGTCACAAAGAGCTTCAACAGGGGAGAGTGTGGA<br>GCCGCAGAACAAAAACTCATCTCAGAAGAGGATCTGA<br>ATGGAGCCGCAGACTACAAGGACGACGACGACAAGGG<br>TGCCGCA |
| 134 | Fab light chain Vk1_5 | DIQMTQSPSTLSASVGDRVTITCRASQSISSWLAWYQQKP<br>GKAPKLLIYDASSLESGVPSRFSGSGSGTEFTLTISSLQPDD<br>FATYYCQQYNSYSTFGQGTKVEIKRTVAAPSVFIFPPSDE<br>QLKSGTASVVCLLNNFYPREAKVQWKVDNALQSGNSQE<br>SVTEQDSKDSTYSLSSTLTLSKADYEKHKVYACEVTHQG<br>LSSPVTKSFNRGECGAAEQKLISEEDLNGAADYKDDDDK<br>GAA |
| 135 | nucleotide sequence of Fab heavy chain VH1_69 | CAGGTGCAATTGGTGCAGTCTGGGGCTGAGGTGAAGA<br>AGCCTGGGTCCTCGGTGAAGGTCTCCTGCAAGGCCTCC<br>GGAGGCACATTCAGCAGCTACGCTATAAGCTGGGTGC<br>GACAGGCCCCTGGACAAGGGCTCGAGTGGATGGGAGG<br>GATCATCCCTATCTTTGGTACAGCAAACTACGCACAGA<br>AGTTCCAGGGCAGGGTCACCATTACTGCAGACAAATCC<br>ACGAGCACAGCCTACATGGAGCTGAGCAGCCTGAGAT<br>CTGAGGACACCGCCGTGTATTACTGTGCGAGACTATCC<br>CCAGGCGGTTACTATGTTATGGATGCCTGGGGCCAAGG<br>GACCACCGTGACCGTCTCCTCAGCTAGCACCAAAGGCC<br>CATCGGTCTTCCCCCTGGCACCCTCCTCCAAGAGCACC<br>TCTGGGGGCACAGCGGCCCTGGGCTGCCTGGTCAAGG<br>ACTACTTCCCCGAACCGGTGACGGTGTCGTGGAACTCA<br>GGCGCCCTGACCAGCGGCGTGCACACCTTCCCGGCTGT<br>CCTACAGTCCTCAGGACTCTACTCCCTCAGCAGCGTGG<br>TGACCGTGCCCTCCAGCAGCTTGGGCACCCAGACCTAC<br>ATCTGCAACGTGAATCACAAGCCCAGCAACACCAAAG<br>TGGACAAGAAAGTTGAGCCCAAATCTTGTGACGCGGC<br>CGCAAGCACTAGTGCCCATCACCATCACCATCACGCCG<br>CGGCA |
| 136 | Fab heavy chain VH1_69 | QVQLVQSGAEVKKPGSSVKVSCKASGGTFSSYAISWVRQ<br>APGQGLEWMGGIIPIFGTANYAQKFQGRVTITADKSTSTA<br>YMELSSLRSEDTAVYYCARLSPGGYYVMDAWGQGTTVT<br>VSSASTKGPSVFPLAPSSKSTSGGTAALGCLVKDYFPEPV<br>TVSWNSGALTSGVHTFPAVLQSSGLYSLSSVVTVPSSSLG<br>TQTYICNVNHKPSNTKVDKKVEPKSCDAAASTSAHHHH<br>HHAAA |

TABLE 40

Primer sequences used for generation of DP88-4 library

| SEQ ID NO: | Primer name | Primer sequence 5'-3' |
|---|---|---|
| 137 | LMB3 | CAGGAAACAGCTATGACCATGATTAC |
| 138 | Vk1_5_L3r_S | CTCGACTTTGGTGCCCTGGCCAAACGTSBAATA<br>CGAATTATACTGTTGGCAGTAATAAGTTGCAAAATCAT<br>underlined: 60% original base and 40% randomization as M.<br>bolded and italic: 60% original base and 40% randomization as N |
| 139 | Vk1_5_L3r_SY | CTCGACTTTGGTGCCCTGGCCAAACGTMHRSGRATACGA<br>ATTATACTGTTGGCAGTAATAAGTTGCAAAATCAT<br>underlined: 60% original base and 40% randomization as M.<br>bolded and italic: 60% original base and 40% randomization as N |
| 140 | Vk1_5_L3r_SPY | CTCGACTTTGGTGCCCTGGCCAAACGTMHHMSSSGRATA<br>CGAATTATACTGTTGGCAGTAATAAGTTGCAAAATCAT<br>underlined: 60% original base and 40% randomization as M.<br>bolded and italic: 60% original base and 40% randomization as N |
| 141 | RJH31 | ACGTTTGGCCAGGGCACCAAAGTCGAG |
| 142 | RJH32 | TCTCGCACAGTAATACACGGCGGTGTCC |

TABLE 40-continued

Primer sequences used for generation of DP88-4 library

| SEQ ID NO | Primer name | Primer sequence 5'-3' |
|---|---|---|
| 143 | DP88-v4-4 | GGACACCGCCGTGTATTACTGTGCGAGA-1-2-2-3-4-GAC-TAC-TGGGGCCAAGGGACCACCGTGACCGTCTCC<br>1: G/D = 20%, E/V/S = 10%, A/P/R/L/T/Y = 5%; 2: G/Y/S = 15%, A/D/T/R/P/L/V/N/W/F/I/E = 4.6%; 3: G/A/Y = 20%, P/W/S/D/T = 8%; 4: F = 46%, L/M = 15%, G/I/Y = 8%. |
| 144 | DP88-v4-6 | GGACACCGCCGTGTATTACTGTGCGAGA-1-2-2-2-2-3-4-GAC-TAC-TGGGGCCAAGGGACCACCGTGACCGTCTCC<br>1: G/D = 20%, E/V/S = 10%, A/P/R/L/T/Y = 5%; 2: G/Y/S = 15%, A/D/T/R/P/L/V/N/W/F/I/E = 4.6%; 3: G/A/Y = 20%, P/W/S/D/T = 8%; 4: F = 46%, L/M = 15%, G/I/Y = 8%. |
| 145 | DP88-v4-8 | GGACACCGCCGTGTATTACTGTGCGAGA-1-2-2-2-2-2-2-3-4-GAC-TAC-TGGGGCCAAGGGACCACCGTGACCGTCTCC<br>1: G/D = 20%, E/V/S = 10%, A/P/R/L/T/Y = 5%; 2: G/Y/S = 15%, A/D/T/R/P/L/V/N/W/F/I/E = 4.6%; 3: G/A/Y = 20%, P/W/S/D/T = 8%; 4: F = 46%, L/M = 15%, G/I/Y = 8%. |
| 146 | fdseqlong | GACGTTAGTAAATGAATTTTCTGTATGAGG |

Table 41 shows the sequence of generic phage-displayed lambda-DP47 library (Vl3_19/VH3_23) template used for PCRs. Table 42 provides cDNA and amino acid sequences of lambda-DP47 library (Vl3_19/VH3_23) germline template and Table 43 shows the Primer sequences used for generation of lambda-DP47 library (Vl3_19/VH3_23).

TABLE 41

Sequence of generic phage- displayed lambda-DP47 library (Vl3_19/VH3_23) template used for PCRs

| SEQ ID NO | Description | Sequence |
|---|---|---|
| 158 | pRJH53 library template of lambda-DP47 library Vl3_19/VH3_23; complete Fab coding region comprising PelB leader sequence + Vl3_19 lambda V-domain + CL constant domain for light chain and PelB + VH3_23 V-domain + CH1 constant domain for heavy chain including tags | ATGAAATACCTATTGCCTACGGCAGCCGCTGGATTGTTATTACTC GCGGCCCAGCCGGCCATGGCCTCGTCTGAGCTGACTCAGGACCC TGCTGTGTCTGTGGCCTTGGGACAGACAGTCAGGATCACATGCC AAGGAGACAGCCTCAGAAGTTATTATGCAAGCTGGTACCAGCAG AAGCCAGGACAGGCCCCTGTACTTGTCATCTATGGTAAAAACAA CCGGCCCTCAGGGATCCCAGACCGATTCTCTGGCTCCAGCTCAG GAAACACAGCTTCCTTGACCATCACTGGGGCTCAGGCGGAAGAT GAGGCTGACTATTACTGTAACTCCCGTGATAGTAGCGGTAATCA TGTGGTATTCGGCGGAGGGACCAAGCTGACCGTCCTAGGACAAC CCAAGGCTGCCCCCAGCGTGACCCTGTTCCCCCCCAGCAGCGAG GAATTGCAGGCCAACAAGGCCACCCTGGTCTGCCTGATCAGCGA CTTCTACCCAGGCGCCGTGACCGTGGCCTGGAAGGCCGACAGCA GCCCCGTGAAGGCCGGCGTGGAGACCACCACCCCCAGCAAGCA GAGCAACAACAAGTACGCCGCCAGCAGCTACCTGAGCCTGACC CCCGAGCAGTGGAAGAGCCACAGGTCCTACAGCTGCCAGGTGA CCCACGAGGGCAGCACCGTGGAGAAAACCGTGGCCCCCACCGA GTGCAGCGGAGCCGCAGAACAAAAACTCATCTCAGAAGAGGAT CTGAATGGAGCCGCAGACTACAAGGACGACGACGACAAGGGTG CCGCATAATAAGGCGCGCCAATTCTATTTCAAGGAGACAGTCAT ATGAAATACCTGCTGCCGACCGCTGCTGCTGGTCTGCTGCTCCTC GCTGCCCAGCCGGCCGATGGCCGAGGTGCAATTGCTGGAGTCTGG GGGAGGCTTGGTACAGCCTGGGGGGTCCCTGAGACTCTCCTGTG CAGCCTCCGGATTCACCTTTAGCAGTTATGCCATGAGCTGGGTCC GCCAGGCTCCAGGGAAGGGGCTGGAGTGGGTCTCAGCTATTAGT GGTAGTGGTGGTAGCACATACTACGCAGACTCCGTGAAGGGCCG GTTCACCATCTCCAGAGACAATTCCAAGAACACGCTGTATCTGC AGATGAACAGCCTGAGAGCCGAGGACACGGCCGTATATTACTGT GCGAAACCGTTTCCGTATTTTGACTACTGGGGCCAAGGAACCCT GGTCACCGTCTCGAGTGCTAGCACCAAAGGCCCATCGGTCTTCC CCCTGGCACCCTCCTCCAAGAGCACCTCTGGGGGCACAGCGGCC CTGGGCTGCCTGGTCAAGGACTACTTCCCCGAACCGGTGACGGT GTCGTGGAACTCAGGCGCCCTGACCAGCGGCGTGCACACCTTCC CGGCTGTCCTACAGTCCTCAGGACTCTACTCCCTCAGCAGCGTG GTGACCGTGCCCTCCAGCAGCTTGGGCACCCAGACCTACATCTG CAACGTGAATCACAAGCCCAGCAACACCAAAGTGGACAAGAAA GTTGAGCCCAAATCTTGTGACGCGGCCGCAAGCACTAGTGCCCA TCACCATCACCATCACGCCGCGGCA |

TABLE 42 cDNA and amino acid sequences of lambda-DP47 library
(Vl3_19/VH3_23) germline template

| SEQ ID NO: | Description | Sequence |
|---|---|---|
| 159 | nucleotide sequence of Fab light chain Vl3_19 | TCGTCTGAGCTGACTCAGGACCCTGCTGTGTCTGTGGCCT<br>TGGGACAGACAGTCAGGATCACATGCCAAGGAGACAGCC<br>TCAGAAGTTATTATGCAAGCTGGTACCAGCAGAAGCCAG<br>GACAGGCCCCTGTACTTGTCATCTATGGTAAAAACAACCG<br>GCCCTCAGGGATCCCAGACCGATTCTCTGGCTCCAGCTCA<br>GGAAACACAGCTTCCTTGACCATCACTGGGGCTCAGGCG<br>GAAGATGAGGCTGACTATTACTGTAACTCCCGTGATAGTA<br>GCGGTAATCATGTGGTATTCGGCGGAGGGACCAAGCTGA<br>CCGTCCTAGGACAACCCAAGGCTGCCCCCAGCGTGACCCT<br>GTTCCCCCCCAGCAGCGAGGAATTGCAGGCCAACAAGGC<br>CACCCTGGTCTGCCTGATCAGCGACTTCTACCCAGGCGCC<br>GTGACCGTGGCCTGGAAGGCCGACAGCAGCCCCGTGAAG<br>GCCGGCGTGGAGACCACCACCCCCAGCAAGCAGAGCAAC<br>AACAAGTACGCCGCCAGCAGCTACCTGAGCCTGACCCCC<br>GAGCAGTGGAAGAGCCACAGGTCCTACAGCTGCCAGGTG<br>ACCCACGAGGGCAGCACCGTGGAGAAAACCGTGGCCCCC<br>ACCGAGTGCAGCGGAGCCGCAGAACAAAACTCATCTCA<br>GAAGAGGATCTGAATGGAGCCGCAGACTACAAGGACGAC<br>GACGACAAGGGTGCCGCA |
| 160 | Fab light chain Vl3_19 | SSELTQDPAVSVALGQTVRITCQGDSLRSYYASWYQQKPGQ<br>APVLVIYGKNNRPSGIPDRFSGSSSGNTASLTITGAQAEDEAD<br>YYCNSRDSSGNHVVFGGGTKLTVLGQPKAAPSVTLFPPSSEE<br>LQANKATLVCLISDFYPGAVTVAWKADSSPVKAGVETTTPS<br>KQSNNKYAASSYLSLTPEQWKSHRSYSCQVTHEGSTVEKTV<br>APTECSGAAEQKLISEEDLNGAADYKDDDDKGAA |
| 150 | nucleotide sequence of Fab heavy chain VH3_23 | see Table 7 |
| 151 | Fab heavy chain VH3_23 (DP47) | see Table 7 |

TABLE 43

Primer sequences used for generation of lambda-DP47 library
(Vl3_19/VH3_23)

| SEQ ID NO: | Primer name | Primer sequence 5'-3' |
|---|---|---|
| 161 | LMB3 | CAGGAAACAGCTATGACCATGATTAC |
| 162 | Vl_3_19_L3r_V | GGACGGTCAGCTTGGTCCCTCCGCCGAATAC V*HV* A*TT* A*CC*<br>G*CT* A*CT* A*TC* A*CG*<br>GGAGTTACAGTAATAGTCAGCCTCATCTTCCGC<br>underlined: 60% original base and 40% randomization as M<br>bold and italic: 60% original base and 40% randomization as N |
| 163 | Vl_3_19_L3r_HV | GGACGGTCAGCTTGGTCCCTCCGCCGAATAC C*MM* A*TG*<br>A*TT* A*CC* G*CT* A*CT* A*TC* A*CG*<br>GGAGTTACAGTAATAGTCAGCCTCATCTTCCGC<br>underlined: 60% original base and 40% randomization as M<br>bolded and italic: 60% original base and 40% randomization as N |
| 164 | Vl_3_19_L3r_HLV | GGACGGTCAGCTTGGTCCCTCCGCCGAATAC R*HM* V*WG*<br>A*TG* A*TT* A*CC* G*CT* A*CT* A*TC* A*CG*<br>GGAGTTACAGTAATAGTCAGCCTCATCTTC CGC<br>underlined: 60% original base and 40% randomization as M<br>bolded and italic: 60% original base and 40% randomization as N |
| 165 | RJH80 | TTCGGCGGAGGGACCAAGCTGACCGTCC |
| 248 | MS63 | TTTCGCACAGTAATATACGGCCGTGTCC |
| 154 | DP47-v4-4 | CGAGGACACGGCCGTATATTACTGTGCG-5-1-2-2-3-4-GAC-<br>TAC-TGGGGCCAAGGAACCCTGGTCACCGTCTCG |

TABLE 43-continued

Primer sequences used for generation of lambda-DP47 library (V1_3_19/VH3_23)

| SEQ ID NO: | Primer name | Primer sequence 5'-3' |
|---|---|---|
| 155 | DP47-v4-6 | CGAGGACACGGCCGTATATTACTGTGCG-5-1-2-2-2-2-3-4-GAC-TAC-TGGGGCCAAGGAACCCTGGTCACCGTCTCG |
| 156 | DP47-v4-8 | CGAGGACACGGCCGTATATTACTGTGCG-5-1-2-2-2-2-2-3-4-GAC-TAC-TGGGGCCAAGGAACCCTGGTCACCGTCTCG |
| 157 | fdseqlong | GACGTTAGTAAATGAATTTTCTGTATGAGG |

1: G/D = 20%, E/V/S = 10%, A/P/R/L/T/Y = 5%;
2: G/Y/S = 15%, A/D/T/R/P/L/V/N/W/F/I/E = 4,6%;
3: G/A/Y = 20%, P/W/S/D/T = 8%;
4: F = 46%, L/M = 15%, G/I/Y = 8%;
5: K = 70%, R = 30%.

Human, murine and cynomolgus 4-1BB (CD137) as antigens for the phage display selections and ELISA- and SPR-based screenings were transiently expressed as N-terminal monomeric Fc-fusion in HEK EBNA cells and in vivo site-specifically biotinylated via co-expression of BirA biotin ligase at the avi-tag recognition sequence located a the C-terminus of the Fc portion carrying the receptor chain (Fc knob chain).

Selection rounds (biopanning) were performed in solution according to the following procedure. First step, pre-clearing of ~$10^{12}$ phagemid particles on maxisorp plates coated with 10 ug/ml of an unrelated human IgG to deplete the libraries of antibodies recognizing the Fc-portion of the antigen; second, incubation of the non-binding phagemid particles with 100 nM biotinylated human or murine 4-1BB for 0.5 h in the presence of 100 nM unrelated non-biotinylated Fc knob-into-hole construct for further depletion of Fc-binders in a total volume of 1 ml; third, capture of biotinylated hu 4-1BB and attached specifically binding phage by transfer to 4 wells of a neutravidin pre-coated microtiter plate for 10 min (in rounds 1 & 3); fourth, washing of respective wells using 5×PBS/Tween20 and 5×PBS; fifth, elution of phage particles by addition of 250 ul 100 mM TEA (triethylamine) per well for 10 min and neutralization by addition of 500 ul 1M Tris/HCl pH 7.4 to the pooled eluates from 4 wells; sixth, post-clearing of neutralized eluates by incubation on neutravidin pre-coated microtiter plate with 100 nM biotin-captured Fc knob-into-hole construct for final removal of Fc-binders; seventh, re-infection of log-phase E. coli TG1 cells with the supernatant of eluted phage particles, infection with helperphage VCSM13, incubation on a shaker at 30° C. over night and subsequent PEG/NaCl precipitation of phagemid particles to be used in the next selection round. Selections were carried out over 3 or 4 rounds using constant antigen concentrations of 100 nM. In rounds 2 and 4, in order to avoid enrichment of binders to neutravidin, capture of antigen: phage complexes was performed by addition of 5.4×$10^7$ streptavidin-coated magnetic beads. Specific binders were identified by ELISA as follows: 100 ul of 25 nM biotinylated human or murine 4-1BB and 10 ug/ml of human IgG were coated on neutravidin plates and maxisorp plates, respectively. Fab-containing bacterial supernatants were added and binding Fabs were detected via their Flag-tags using an anti-Flag/HRP secondary antibody. Clones exhibiting signals on human or murine 4-1BB and being negative on human IgG were short-listed for further analyses and were also tested in a similar fashion against the remaining two species of 4-1BB. They were bacterially expressed in a 0.5 liter culture volume, affinity purified and further characterized by SPR-analysis using BioRad's ProteOn XPR36 biosensor.

Clones 12B3, 25G7, 11D5 and 9B11 were identified as human 4-1BB-specific binder through the procedure described above. Clone 20G2 was identified as murine 4-1BB-specific binder through the procedure described above. The cDNA sequences of their variable regions are shown in Table 44 below, the corresponding amino acid sequences can be found in Table C.

TABLE 44

Variable region base pair sequences for phage-derived anti-4-1BB antibodies. Underlined are the complementarity determining regions (CDRs).

| Clone | SEQ ID NO: | | Sequence |
|---|---|---|---|
| 12B3 | 249 | (VL) | GACATCCAGATGACCCAGTCTCCTTCCACCCTGTCTGCATCTGTAGG AGACCGTGTCACCATCACTTGCCGTGCCAGTCAGAGTATTAGTAGC TGGTTGGCCTGGTATCAGCAGAAACCAGGGAAAGCCCCTAAGCTCC TGATCTATGATGCCTCCAGTTTGGAAAGTGGGGTCCCATCACGTTTC AGCGGCAGTGGATCCGGGACAGAATTCACTCTCACCATCAGCAGCT TGCAGCCTGATGATTTTGCAACTTATTACTGCCAACAGTATCATTCG TATCCGCAGACGTTTGGCCAGGGCACCAAAGTCGAGATCAAG |
| | 250 | (VH) | CAGGTGCAATTGGTGCAGTCTGGGGCTGAGGTGAAGAAGCCTGGGT CCTCGGTGAAGGTCTCCTGCAAGGCCTCCGGAGGCACATTCAGCAG CTACGCTATAAGCTGGGTGCGACAGGCCCCTGGACAAGGGCTCGAG TGGATGGGAGGGATCATCCCTATCTTTGGTACAGCAAACTACGCAC AGAAGTTCCAGGGCAGGGTCACCATTACTGCAGACAAATCCACGAG |

TABLE 44-continued

Variable region base pair sequences for phage-derived anti-4-1BB antibodies. Underlined are the complementarity determining regions (CDRs).

| Clone | SEQ ID NO: | Sequence |
|---|---|---|
| | | CACAGCCTACATGGAGCTGAGCAGCCTGAGATCTGAGGACACCGCC<br>GTGTATTACTGTGCGAGA<u>TCTGAATTCCGTTTCTACGCTGACTTCGA</u><br><u>CTAC</u>TGGGGCCAAGGGACCACCGTGACCGTCTCCTCA |
| 25G7 | 251 (VL) | TCGTCTGAGCTGACTCAGGACCCTGCTGTGTCTGTGGCCTTGGGACA<br>GACAGTCAGGATCACATGC<u>CAAGGAGACAGCCTCAGAAGTTATTAT</u><br><u>GCAAGC</u>TGGTACCAGCAGAAGCCAGGACAGGCCCTGTACTTGTCA<br>TCTAT<u>GGTAAAAACAACCGGCCCTC</u>AGGGATCCCAGACCGATTCTC<br>TGGCTCCAGCTCAGGAAACACAGCTTCCTTGACCATCACTGGGGCT<br>CAGGCGGAAGATGAGGCTGACTATTACTGT<u>AACTCCCTTGATAGGC</u><br><u>GCGGTATGTGGGTA</u>TTCGGCGGAGGGACCAAGCTGACCGTC |
| | 252 (VH) | GAGGTGCAATTGTTGGAGTCTGGGGGAGGCTTGGTACAGCCTGGGG<br>GGTCCCTGAGACTCTCCTGTGCAGCCTCCGGATTCACCTTTAGC<u>AGT</u><br><u>TATGCCATGAGC</u>TGGGTCCGCCAGGCTCCAGGGAAGGGGCTGGAGT<br>GGGTCTCA<u>GCTATTAGTGGTAGTGGTGGTAGCACATACTACGCAGA</u><br><u>CTCCGTGAAGGGC</u>CGGTTCACCATCTCCAGAGACAATTCCAAGAAC<br>ACGCTGTATCTGCAGATGAACAGCCTGAGAGCCGAGGACACGGCCG<br>TATATTACTGTGCGCGT<u>GACGACCCGTGGCCGCCGTTCGACTAC</u>TGG<br>GGCCAAGGAACCCTGGTCACCGTCTCGAGT |
| 11D5 | 253 (VL) | GACATCCAGATGACCCAGTCTCCTTCCACCCTGTCTGCATCTGTAGG<br>AGACCGTGTCACCATCACTTGC<u>CGTGCCAGTCAGAGTATTAGTAGC</u><br><u>TGGTTGGCC</u>TGGTATCAGCAGAAACCAGGGAAAGCCCCTAAGCTCC<br>TGATCTAT<u>GATGCCTCCAGTTTGGAAAGT</u>GGGGTCCCATCACGTTTC<br>AGCGGCAGTGGATCCGGGACAGAATTCACTCTCACCATCAGCAGCT<br>TGCAGCCTGATGATTTTGCAACTTATTACTGC<u>CAACAGCTTAATTCG</u><br><u>TATCCTCAGACG</u>TTTGGCCAGGGCACCAAAGTCGAGATCAAG |
| | 254 (VH) | CAGGTGCAATTGGTGCAGTCTGGGGCTGAGGTGAAGAAGCCTGGGT<br>CCTCGGTGAAGGTCTCCTGCAAGGCCTCCGGAGGCACATTCAGC<u>AG</u><br><u>CTACGCTATAAGC</u>TGGGTGCGACAGGCCCCTGGACAAGGGCTCGAG<br>TGGATGGGA<u>GGGATCATCCCTATCTTTGGTACAGCAAACTACGCAC</u><br><u>AGAAGTTCCAGGGC</u>AGGGTCACCATTACTGCAGACAAATCCACGAG<br>CACAGCCTACATGGAGCTGAGCAGCCTGAGATCTGAGGACACCGCC<br>GTGTATTACTGTGCGAGA<u>TCTACTCTGATCTACGGTTACTTCGACTA</u><br><u>C</u>TGGGGCCAAGGGACCACCGTGACCGTCTCCTCA |
| 9B11 | 255 (VL) | GACATCCAGATGACCCAGTCTCCTTCCACCCTGTCTGCATCTGTAGG<br>AGACCGTGTCACCATCACTTGC<u>CGTGCCAGTCAGAGTATTAGTAGC</u><br><u>TGGTTGGCC</u>TGGTATCAGCAGAAACCAGGGAAAGCCCCTAAGCTCC<br>TGATCTAT<u>GATGCCTCCAGTTTGGAAAGT</u>GGGGTCCCATCACGTTTC<br>AGCGGCAGTGGATCCGGGACAGAATTCACTCTCACCATCAGCAGCT<br>TGCAGCCTGATGATTTTGCAACTTATTACTGC<u>CAACAGGTTAATTCT</u><br><u>TATCCGCAGACG</u>TTTGGCCAGGGCACCAAAGTCGAGATCAAG |
| | 256 (VH) | CAGGTGCAATTGGTGCAGTCTGGGGCTGAGGTGAAGAAGCCTGGGT<br>CCTCGGTGAAGGTCTCCTGCAAGGCCTCCGGAGGCACATTCAGC<u>AG</u><br><u>CTACGCTATAAGC</u>TGGGTGCGACAGGCCCCTGGACAAGGGCTCGAG<br>TGGATGGGA<u>GGGATCATCCCTATCTTTGGTACAGCAAACTACGCAC</u><br><u>AGAAGTTCCAGGGC</u>AGGGTCACCATTACTGCAGACAAATCCACGAG<br>CACAGCCTACATGGAGCTGAGCAGCCTGAGATCTGAGGACACCGCC<br>GTGTATTACTGTGCGAGA<u>TCTTCTGGTGCTTACCCGGGTTACTTCGA</u><br><u>CTAC</u>TGGGGCCAAGGGACCACCGTGACCGTCTCCTCA |
| 20G2 | 257 (VL) | GACATCCAGATGACCCAGTCTCCATCCACCCTGTCTGCATCTGTAGG<br>AGACCGTGTCACCATCACTTGC<u>CGTGCCAGTCAGAGTATTAGTAGC</u><br><u>TGGTTGGCC</u>TGGTATCAGCAGAAACCAGGGAAAGCCCCTAAGCTCC<br>TGATCTAT<u>GATGCCTCCAGTTTGGAAAGT</u>GGGGTCCCATCACGTTTC<br>AGCGGCAGTGGATCCGGGACAGAATTCACTCTCACCATCAGCAGCT<br>TGCAGCCTGATGATTTTGCAACTTATTACTGC<u>CAACAGCAGCACTCG</u><br><u>TATTATACG</u>TTTGGCCAGGGCACCAAAGTCGAGATCAAG |
| | 258 (VH) | CAGGTGCAATTGGTGCAGTCTGGGGCTGAGGTGAAGAAGCCTGGGT<br>CCTCGGTGAAGGTCTCCTGCAAGGCCTCCGGAGGCACATTCAGC<u>AG</u><br><u>CTACGCTATAAGC</u>TGGGTGCGACAGGCCCCTGGACAAGGGCTCGAG<br>TGGATGGGA<u>GGGATCATCCCTATCTTTGGTACAGCAAACTACGCAC</u><br><u>AGAAGTTCCAGGGC</u>AGGGTCACCATTACTGCAGACAAATCCACGAG<br>CACAGCCTACATGGAGCTGAGCAGCCTGAGATCTGAGGACACCGCC<br>GTGTATTACTGTGCGAGA<u>TCTTACTACTGGGAATCTTACCCGTTCGA</u><br><u>CTAC</u>TGGGGCCAAGGGACCACCGTGACCGTCTCCAGC |

6.3 Preparation, Purification and Characterization of Anti-4-1BB IgG1 P329G LALA Antibodies The variable regions of heavy and light chain DNA sequences of selected anti-4-1BB binders were subcloned in frame with either the constant heavy chain or the constant light chain of human IgG1. The Pro329Gly, Leu234Ala and Leu235Ala mutations have been introduced in the constant region of the knob and hole heavy chains to abrogate binding to Fc gamma receptors according to the method described in International Patent Appl. Publ. No. WO 2012/130831 A1.

The nucleotide and amino acid sequences of the anti-4-1BB clones are shown in Table 45. All anti-4-1BB-Fc-fusion encoding sequences were cloned into a plasmid vector, which drives expression of the insert from an MPSV promoter and contains a synthetic polyA signal sequence located at the 3' end of the CDS. In addition, the vector contains an EBV OriP sequence for episomal maintenance of the plasmid.

TABLE 45

Sequences of anti-4-1BB clones in P329GLALA human IgG1 format

| Clone | SEQ ID No. | Sequence |
| --- | --- | --- |
| 12B3 | 259 (nucleotide sequence light chain) | GACATCCAGATGACCCAGTCTCCTTCCACCCTGTCTGCATCTGT AGGAGACCGTGTCACCATCACTTGCCGTGCCAGTCAGAGTATT AGTAGCTGGTTGGCCTGGTATCAGCAGAAACCAGGGAAAGCC CCTAAGCTCCTGATCTATGATGCCTCCAGTTTGGAAAGTGGGG TCCCATCACGTTTCAGCGGCAGTGGATCCGGGACAGAATTCAC TCTCACCATCAGCAGCTTGCAGCCTGATGATTTTGCAACTTATT ACTGCCAACAGTATCATTCGTATCCGCAGACGTTTGGCCAGGG CACCAAAGTCGAGATCAAGCGTACGGTGGCTGCACCATCTGTC TTCATCTTCCCGCCATCTGATGAGCAGTTGAAATCTGGAACTGC CTCTGTTGTGTGCCTGCTGAATAACTTCTATCCCAGAGAGGCCA AAGTACAGTGGAAGGTGGATAACGCCCTCCAATCGGGTAACTC CCAGGAGAGTGTCACAGAGCAGGACAGCAAGGACAGCACCTA CAGCCTCAGCAGCACCCTGACGCTGAGCAAAGCAGACTACGA GAAACACAAAGTCTACGCCTGCGAAGTCACCCATCAGGGCCTG AGCTCGCCCGTCACAAAGAGCTTCAACAGGGGAGAGTGT |
| | 260 (nucleotide sequence heavy chain) | CAGGTGCAATTGGTGCAGTCTGGGGCTGAGGTGAAGAAGCCTG GGTCCTCGGTGAAGGTCTCCTGCAAGGCCTCCGGAGGCACATT CAGCAGCTACGCTATAAGCTGGGTGCGACAGGCCCCTGGACAA GGGCTCGAGTGGATGGGAGGGATCATCCCTATCTTTGGTACAG CAAACTACGCACAGAAGTTCCAGGGCAGGGTCACCATTACTGC AGACAAATCCACGAGCACAGCCTACATGGAGCTGAGCAGCCT GAGATCTGAGGACACCGCCGTGTATTACTGTGCGAGATCTGAA TTCCGTTTCTACGCTGACTTCGACTACTGGGGCCAAGGGACCA CCGTGACCGTCTCCTCAGCTAGCACCAAGGGCCCATCGGTCTT CCCCCTGGCACCCTCCTCCAAGAGCACCTCTGGGGGCACAGCG GCCCTGGGCTGCCTGGTCAAGGACTACTTCCCCGAACCGGTGA CGGTGTCGTGGAACTCAGGCGCCCTGACCAGCGGCGTGCACAC CTTCCCGGCTGTCCTACAGTCCTCAGGACTCTACTCCCTCAGCA GCGTGGTGACCGTGCCCTCCAGCAGCTTGGGCACCCAGACCTA CATCTGCAACGTGAATCACAAGCCCAGCAACACCAAGGTGGA CAAGAAAGTTGAGCCCAAATCTTGTGACAAAACTCACACATGC CCACCGTGCCCAGCACCTGAAGCTGCAGGGGGACCGTCAGTCT TCCTCTTCCCCCCAAAACCCAAGGACACCCTCATGATCTCCCG GACCCCTGAGGTCACATGCGTGGTGGTGGACGTGAGCCACGAA GACCCTGAGGTCAAGTTCAACTGGTACGTGGACGGCGTGGAGG TGCATAATGCCAAGACAAAGCCGCGGGAGGAGCAGTACAACA GCACGTACCGTGTGGTCAGCGTCCTCACCGTCCTGCACCAGGA CTGGCTGAATGGCAAGGAGTACAAGTGCAAGGTCTCCAACAA AGCCCTCGGCGCCCCCATCGAGAAAACCATCTCCAAAGCCAAA GGGCAGCCCCGAGAACCACAGGTGTACACCCTGCCCCCATCCC GGGATGAGCTGACCAAGAACCAGGTCAGCCTGACCTGCCTGGT CAAAGGCTTCTATCCCAGCGACATCGCCGTGGAGTGGGAGAGC AATGGGCAGCCGGAGAACAACTACAAGACCACGCCTCCCGTG CTGGACTCCGACGGCTCCTTCTTCCTCTACAGCAAGCTCACCGT GGACAAGAGCAGGTGGCAGCAGGGGAACGTCTTCTCATGCTCC GTGATGCATGAGGCTCTGCACAACCACTACACGCAGAAGAGCC TCTCCCTGTCTCCGGGTAAA |
| | 261 Light chain) | DIQMTQSPSTLSASVGDRVTITCRASQSISSWLAWYQQKPG KAPKLLIYDASSLESGVPSRFSGSGSGTEFTLTISSLQPDDFA TYYCQQYHSYPQTFGQGTKVEIKRTVAAPSVFIFPPSDEQLK SGTASVVCLLNNFYPREAKVQWKVDNALQSGNSQESVTEQ DSKDSTYSLSSTLTLSKADYEKHKVYACEVTHQGLSSPVTK SFNRGEC |
| | 262 (Heavy chain) | QVQLVQSGAEVKKPGSSVKVSCKASGGTFSSYAISWVRQAP GQGLEWMGGIIPIFGTANYAQKFQGRVTITADKSTSTAYME LSSLRSEDTAVYYCARSEFRFYADFDYWGQGTTVTVSSAST KGPSVFPLAPSSKSTSGGTAALGCLVKDYFPEPVTVSWNSG ALTSGVHTFPAVLQSSGLYSLSSVVTVPSSSLGTQTYICNVN HKPSNTKVDKKVEPKSCDKTHTCPPCPAPEAAGGPSVFLPP KPKDTLMISRTPEVTCVVVDVSHEDPEVKFNWYVDGVEVH NAKTKPREEQYNSTYRVVSVLTVLHQDWLNGKEYKCKVS NKALGAPIEKTISKAKGQPREPQVYTLPPSRDELTKNQVSLT |

TABLE 45-continued

Sequences of anti-4-1BB clones in P329GLALA human IgG1 format

| Clone | SEQ ID No. | Sequence |
|---|---|---|
| | | CLVKGFYPSDIAVEWESNGQPENNYKTTPPVLDSDGSFFLY<br>SKLTVDKSRWQQGNVFSCSVMHEALHNHYTQKSLSLSPGK |
| 25G7 | 263<br>(nucleotide<br>sequence light<br>chain) | TCGTCTGAGCTGACTCAGGACCCTGCTGTGTCTGTGGCCTTGGG<br>ACAGACAGTCAGGATCACATGCCAAGGAGACAGCCTCAGAAG<br>TTATTATGCAAGCTGGTACCAGCAGAAGCCAGGACAGGCCCCT<br>GTACTTGTCATCTATGGTAAAAACAACCGGCCCTCAGGGATCC<br>CAGACCGATTCTCTGGCTCCAGCTCAGGAAACACAGCTTCCTT<br>GACCATCACTGGGGCTCAGGCGGAAGATGAGGCTGACTATTAC<br>TGTAACTCCCTTGATAGGCGCGGTATGTGGGTATTCGGCGGAG<br>GGACCAAGCTGACCGTCCTAGGTCAACCCAAGGCTGCCCCCAG<br>CGTGACCCTGTTCCCCCCCAGCAGCGAGGAACTGCAGGCCAAC<br>AAGGCCACCCTGGTCTGCCTGATCAGCGACTTCTACCCAGGCG<br>CCGTGACCGTGGCCTGGAAGGCCGACAGCAGCCCCGTGAAGG<br>CCGGCGTGGAGACCACCACCCCCAGCAAGCAGAGCAACAACA<br>AGTACGCCGCCAGCAGCTACCTGAGCCTGACCCCCGAGCAGTG<br>GAAGAGCCACAGGTCCTACAGCTGCCAGGTGACCCACGAGGG<br>CAGCACCGTGGAGAAAACCGTGGCCCCCACCGAGTGCAGC |
| | 264<br>(nucleotide<br>sequence heavy<br>chain) | GAGGTGCAATTGTTGGAGTCTGGGGGAGGCTTGGTACAGCCTG<br>GGGGGTCCCTGAGACTCTCCTGTGCAGCCTCCGGATTCACCTTT<br>AGCAGTTATGCCATGAGCTGGGTCCGCCAGGCTCCAGGGAAGG<br>GGCTGGAGTGGGTCTCAGCTATTAGTGGTAGTGGTGGTAGCAC<br>ATACTACGCAGACTCCGTGAAGGGCCGGTTCACCATCTCCAGA<br>GACAATTCCAAGAACACGCTGTATCTGCAGATGAACAGCCTGA<br>GAGCCGAGGACACGGCCGTATATTACTGTGCGCGTGACGACCC<br>GTGGCCGCCGTTCGACTACTGGGGCCAAGGAACCCTGGTCACC<br>GTCTCGAGTGCTAGCACCAAGGGCCCATCGGTCTTCCCCCTGG<br>CACCCTCCTCCAAGAGCACCTCTGGGGGCACAGCGGCCCTGGG<br>CTGCCTGGTCAAGGACTACTTCCCCGAACCGGTGACGGTGTCG<br>TGGAACTCAGGCGCCCTGACCAGCGGCGTGCACACCTTCCCGG<br>CTGTCCTACAGTCCTCAGGACTCTACTCCCTCAGCAGCGTGGTG<br>ACCGTGCCCTCCAGCAGCTTGGGCACCCAGACCTACATCTGCA<br>ACGTGAATCACAAGCCCAGCAACACCAAGGTGGACAAGAAAG<br>TTGAGCCCAAATCTTGTGACAAAACTCACACATGCCCACCGTG<br>CCCAGCACCTGAAGCTGCAGGGGGACCGTCAGTCTTCCTCTTC<br>CCCCCAAAACCCAAGGACACCCTCATGATCTCCCGGACCCCTG<br>AGGTCACATGCGTGGTGGTGGACGTGAGCCACGAAGACCCTG<br>AGGTCAAGTTCAACTGGTACGTGGACGGCGTGGAGGTGCATAA<br>TGCCAAGACAAAGCCGCGGGAGGAGCAGTACAACAGCACGTA<br>CCGTGTGGTCAGCGTCCTCACCGTCCTGCACCAGGACTGGCTG<br>AATGGCAAGGAGTACAAGTGCAAGGTCTCCAACAAAGCCCTC<br>GGCGCCCCCATCGAGAAAACCATCTCCAAAGCCAAAGGGCAG<br>CCCCGAGAACCACAGGTGTACACCCTGCCCCCATCCCGGGATG<br>AGCTGACCAAGAACCAGGTCAGCCTGACCTGCCTGGTCAAAGG<br>CTTCTATCCCAGCGACATCGCCGTGGAGTGGGAGAGCAATGGG<br>CAGCCGGAGAACAACTACAAGACCACGCCTCCCGTGCTGGACT<br>CCGACGGCTCCTTCTTCCTCTACAGCAAGCTCACCGTGGACAA<br>GAGCAGGTGGCAGCAGGGGAACGTCTTCTCATGCTCCGTGATG<br>CATGAGGCTCTGCACAACCACTACACGCAGAAGAGCCTCTCCC<br>TGTCTCCGGGTAAA |
| | 265<br>(Light chain) | SSELTQDPAVSVALGQTVRITCQGDSLRSYYASWYQQKPGQAPV<br>LVIYGKNNRPSGIPDRFSGSSSGNTASLTITGAQAEDEADYYCNSL<br>DRRGMWVFGGGTKLTVLGQPKAAPSVTLFPPSSEELQANKATLV<br>CLISDFYPGAVTVAWKADSSPVKAGVETTTPSKQSNNKYAASSYL<br>SLTPEQWKSHRSYSCQVTHEGSTVEKTVAPTECS |
| | 266<br>(Heavy chain) | EVQLLESGGGLVQPGGSLRLSCAASGFTFSSYAMSWVRQAPGKG<br>LEWVSAISGSGGSTYYADSVKGRFTISRDNSKNTLYLQMNSLRAE<br>DTAVYYCARDDPWPPFDYWGQGTLVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKKVEPKSCDK<br>THTCPPCPAPEAAGGPSVFLFPPKPKDTLMISRTPEVTCVVVDVSH<br>EDPEVKFNWYVDGVEVHNAKTKPREEQYNSTYRVVSVLTVLHQ<br>DWLNGKEYKCKVSNKALGAPIEKTISKAKGQPREPQVYTLPPSRD<br>ELTKNQVSLTCLVKGFYPSDIAVEWESNGQPENNYKTTPPVLDSD<br>GSFFLYSKLTVDKSRWQQGNVFSCSVMHEALHNHYTQKSLSLSP<br>GK |
| 11D5 | 267<br>(nucleotide<br>sequence light<br>chain) | GACATCCAGATGACCCAGTCTCCTTCCACCCTGTCTGCATCTGT<br>AGGAGACCGTGTCACCATCACTTGCCGTGCCAGTCAGAGTATT<br>AGTAGCTGGTTGGCCTGGTATCAGCAGAAACCAGGGAAAGCC<br>CCTAAGCTCCTGATCTATAAGGCCTCCAGTTTGGAAAGTGGGG<br>TCCCATCACGTTTCAGCGGCAGTGGATCCGGGACAGAATTCAC<br>TCTCACCATCAGCAGCTTGCAGCCTGATGATTTTGCAACTTATT<br>ACTGCCAACAGCTTAATTCGTATCCTCAGACGTTTGGCCAGGG<br>CACCAAAGTCGAGATCAAGCGTACGGTGGCTGCACCATCTGTC<br>TTCATCTTCCCGCCATCTGATGAGCAGTTGAAATCTGGAACTGC |

TABLE 45-continued

Sequences of anti-4-1BB clones in P329GLALA human IgG1 format

| Clone | SEQ ID No. | Sequence |
|---|---|---|
| | 268 (nucleotide sequence heavy chain) | CTCTGTTGTGTGCCTGCTGAATAACTTCTATCCCAGAGAGGCCA<br>AAGTACAGTGGAAGGTGGATAACGCCCTCCAATCGGGTAACTC<br>CCAGGAGAGTGTCACAGAGCAGGACAGCAAGGACAGCACCTA<br>CAGCCTCAGCAGCACCCTGACGCTGAGCAAAGCAGACTACGA<br>GAAACACAAAGTCTACGCCTGCGAAGTCACCCATCAGGGCCTG<br>AGCTCGCCCGTCACAAAGAGCTTCAACAGGGGAGAGTGT<br>CAGGTGCAATTGGTGCAGTCTGGGGCTGAGGTGAAGAAGCCTG<br>GGTCCTCGGTGAAGGTCTCCTGCAAGGCCTCCGGAGGCACATT<br>CAGCAGCTACGCTATAAGCTGGGTGCGACAGGCCCCTGGACAA<br>GGGCTCGAGTGGATGGGAGGGATCATCCCTATCTTTGGTACAG<br>CAAACTACGCACAGAAGTTCCAGGGCAGGGTCACCATTACTGC<br>AGACAAATCCACGAGCACAGCCTACATGGAGCTGAGCAGCCT<br>GAGATCTGAGGACACCGCCGTGTATTACTGTGCGAGATCTACT<br>CTGATCTACGGTTACTTCGACTACTGGGGCCAAGGGACCACCG<br>TGACCGTCTCCTCAGCTAGCACCAAGGGCCCATCGGTCTTCCC<br>CCTGGCACCCTCCTCCAAGAGCACCTCTGGGGGCACAGCGGCC<br>CTGGGCTGCCTGGTCAAGGACTACTTCCCCGAACCGGTGACGG<br>TGTCGTGGAACTCAGGCGCCCTGACCAGCGGCGTGCACACCTT<br>CCCGGCTGTCCTACAGTCCTCAGGACTCTACTCCCTCAGCAGC<br>GTGGTGACCGTGCCCTCCAGCAGCTTGGGCACCCAGACCTACA<br>TCTGCAACGTGAATCACAAGCCCAGCAACACCAAGGTGGACA<br>AGAAAGTTGAGCCCAAATCTTGTGACAAAACTCACACATGCCC<br>ACCGTGCCCAGCACCTGAAGCTGCAGGGGGACCGTCAGTCTTC<br>CTCTTCCCCCCAAAACCCAAGGACACCCTCATGATCTCCCGGA<br>CCCCTGAGGTCACATGCGTGGTGGTGGACGTGAGCCACGAAGA<br>CCCTGAGGTCAAGTTCAACTGGTACGTGGACGGCGTGGAGGTG<br>CATAATGCCAAGACAAAGCCGCGGGAGGAGCAGTACAACAGC<br>ACGTACCGTGTGGTCAGCGTCCTCACCGTCCTGCACCAGGACT<br>GGCTGAATGGCAAGGAGTACAAGTGCAAGGTCTCCAACAAAG<br>CCCTCGGCGCCCCCATCGAGAAAACCATCTCCAAAGCCAAAGG<br>GCAGCCCCGAGAACCACAGGTGTACACCCTGCCCCCATCCCGG<br>GATGAGCTGACCAAGAACCAGGTCAGCCTGACCTGCCTGGTCA<br>AAGGCTTCTATCCCAGCGACATCGCCGTGGAGTGGGAGAGCAA<br>TGGGCAGCCGGAGAACAACTACAAGACCACGCCTCCCGTGCTG<br>GACTCCGACGGCTCCTTCTTCCTCTACAGCAAGCTCACCGTGG<br>ACAAGAGCAGGTGGCAGCAGGGGAACGTCTTCTCATGCTCCGT<br>GATGCATGAGGCTCTGCACAACCACTACACGCAGAAGAGCCTC<br>TCCCTGTCTCCGGGTAAA |
| | 269 (Light chain) | DIQMTQSPSTLSASVGDRVTITCRASQSISSWLAWYQQKPGKAPK<br>LLIYDASSLESGVPSRFSGSGSGTEFTLTISSLQPDDFATYYCQQLN<br>SYPQTFGQGTKVEIKRTVAAPSVFIFPPSDEQLKSGTASVVCLLNN<br>FYPREAKVQWKVDNALQSGNSQESVTEQDSKDSTYSLSSTLTLSK<br>ADYEKHKVYACEVTHQGLSSPVTKSFNRGEC |
| | 270 (Heavy chain) | QVQLVQSGAEVKKPGSSVKVSCKASGGTFSSYAISWVRQAPGQG<br>LEWMGGIIPIFGTANYAQKFQGRVTITADKSTSTAYMELSSLRSED<br>TAVYYCARSTLIYGYFDYWGQGTTVTVSSASTKGPSVFPLAPSSK<br>STSGGTAALGCLVKDYFPEPVTVSWNSGALTSGVHTFPAVLQSSG<br>LYSLSSVVTVPSSSLGTQTYICNVNHKPSNTKVDKKVEPKSCDKT<br>HTCPPCPAPEAAGGPSVFLFPPKPKDTLMISRTPEVTCVVVDVSHE<br>DPEVKFNWYVDGVEVHNAKTKPREEQYNSTYRVVSVLTVLHQD<br>WLNGKEYKCKVSNKALGAPIEKTISKAKGQPREPQVYTLPPSRDE<br>LTKNQVSLTCLVKGFYPSDIAVEWESNGQPENNYKTTPPVLDSDG<br>SFFLYSKLTVDKSRWQQGNVFSCSVMHEALHNHYTQKSLSLSPGK |
| 9B11 | 271 (nucleotide sequence light chain) | GACATCCAGATGACCCAGTCTCCTTCCACCCTGTCTGCATCTGT<br>AGGAGACCGTGTCACCATCACTTGCCGTGCCAGTCAGAGTATT<br>AGTAGCTGGTTGGCCTGGTATCAGCAGAAACCAGGGAAAGCC<br>CCTAAGCTCCTGATCTATGATGCCTCCAGTTTGGAAAGTGGGG<br>TCCCATCACGTTTCAGCGGCAGTGGATCCGGGACAGAATTCAC<br>TCTCACCATCAGCAGCTTGCAGCCTGATGATTTTGCAACTTATT<br>ACTGCCAACAGGTTAATTCTTATCCGCAGACGTTTGGCCAGGG<br>CACCAAAGTCGAGATCAAGCGTACGGTGGCTGCACCATCTGTC<br>TTCATCTTCCCGCCATCTGATGAGCAGTTGAAATCTGGAACTGC<br>CTCTGTTGTGTGCCTGCTGAATAACTTCTATCCCAGAGAGGCCA<br>AAGTACAGTGGAAGGTGGATAACGCCCTCCAATCGGGTAACTC<br>CCAGGAGAGTGTCACAGAGCAGGACAGCAAGGACAGCACCTA<br>CAGCCTCAGCAGCACCCTGACGCTGAGCAAAGCAGACTACGA<br>GAAACACAAAGTCTACGCCTGCGAAGTCACCCATCAGGGCCTG<br>AGCTCGCCCGTCACAAAGAGCTTCAACAGGGGAGAGTGT |
| | 272 (nucleotide sequence heavy chain) | CAGGTGCAATTGGTGCAGTCTGGGGCTGAGGTGAAGAAGCCTG<br>GGTCCTCGGTGAAGGTCTCCTGCAAGGCCTCCGGAGGCACATT<br>CAGCAGCTACGCTATAAGCTGGGTGCGACAGGCCCCTGGACAA<br>GGGCTCGAGTGGATGGGAGGGATCATCCCTATCTTTGGTACAG<br>CAAACTACGCACAGAAGTTCCAGGGCAGGGTCACCATTACTGC<br>AGACAAATCCACGAGCACAGCCTACATGGAGCTGAGCAGCCT<br>GAGATCTGAGGACACCGCCGTGTATTACTGTGCGAGATCTTCT |

TABLE 45-continued

Sequences of anti-4-1BB clones in P329GLALA human IgG1 format

| Clone | SEQ ID No. | Sequence |
|---|---|---|
| | | GGTGCTTACCCGGGTTACTTCGACTACTGGGGCCAAGGGACCA<br>CCGTGACCGTCTCCTCAGCTAGCACCAAGGGCCCATCGGTCTT<br>CCCCCTGGCACCCTCCTCCAAGAGCACCTCTGGGGGCACAGCG<br>GCCCTGGGCTGCCTGGTCAAGGACTACTTCCCCGAACCGGTGA<br>CGGTGTCGTGGAACTCAGGCGCCCTGACCAGCGGCGTGCACAC<br>CTTCCCGGCTGTCCTACAGTCCTCAGGACTCTACTCCCTCAGCA<br>GCGTGGTGACCGTGCCCTCCAGCAGCTTGGGCACCCAGACCTA<br>CATCTGCAACGTGAATCACAAGCCCAGCAACACCAAGGTGGA<br>CAAGAAAGTTGAGCCCAAATCTTGTGACAAAACTCACACATGC<br>CCACCGTGCCCAGCACCTGAAGCTGCAGGGGGACCGTCAGTCT<br>TCCTCTTCCCCCCAAAACCCAAGGACACCCTCATGATCTCCCG<br>GACCCCTGAGGTCACATGCGTGGTGGTGGACGTGAGCCACGAA<br>GACCCTGAGGTCAAGTTCAACTGGTACGTGGACGGCGTGGAGG<br>TGCATAATGCCAAGACAAAGCCGCGGGAGGAGCAGTACAACA<br>GCACGTACCGTGTGGTCAGCGTCCTCACCGTCCTGCACCAGGA<br>CTGGCTGAATGGCAAGGAGTACAAGTGCAAGGTCTCCAACAA<br>AGCCCTCGGCGCCCCCATCGAGAAAACCATCTCCAAAGCCAAA<br>GGGCAGCCCCGAGAACCACAGGTGTACACCCTGCCCCCATCCC<br>GGGATGAGCTGACCAAGAACCAGGTCAGCCTGACCTGCCTGGT<br>CAAAGGCTTCTATCCCAGCGACATCGCCGTGGAGTGGGAGAGC<br>AATGGGCAGCCGGAGAACAACTACAAGACCACGCCTCCCGTG<br>CTGGACTCCGACGGCTCCTTCTTCCTCTACAGCAAGCTCACCGT<br>GGACAAGAGCAGGTGGCAGCAGGGGAACGTCTTCTCATGCTCC<br>GTGATGCATGAGGCTCTGCACAACCACTACACGCAGAAGAGCC<br>TCTCCCTGTCTCCGGGTAAA |
| | 273<br>(Light chain) | DIQMTQSPSTLSASVGDRVTITCRASQSISSWLAWYQQKPGKAPK<br>LLIYDASSLESGVPSRFSGSGSGTEFTLTISSLQPDDFATYYCQQVN<br>SYPQTFGQGTKVEIKRTVAAPSVFIFPPSDEQLKSGTASVVCLLNN<br>FYPREAKVQWKVDNALQSGNSQESVTEQDSKDSTYSLSSTLTLSK<br>ADYEKHKVYACEVTHQGLSSPVTKSFNRGEC |
| | 274<br>(Heavy chain) | QVQLVQSGAEVKKPGSSVKVSCKASGGTFSSYAISWVRQAPGQG<br>LEWMGGIIPIFGTANYAQKFQGRVTITADKSTSTAYMELSSLRSED<br>TAVYYCARSSGAYPGYFDYWGQGTTVTVSSASTKGPSVFPLAPSS<br>KSTSGGTAALGCLVKDYFPEPVTVSWNSGALTSGVHTFPAVLQSS<br>GLYSLSSVVTVPSSSLGTQTYICNVNHKPSNTKVDKKVEPKSCDK<br>THTCPPCPAPEAAGGPSVFLFPPKPKDTLMISRTPEVTCVVVDVSH<br>EDPEVKFNWYVDGVEVHNAKTKPREEQYNSTYRVVSVLTVLHQ<br>DWLNGKEYKCKVSNKALGAPIEKTISKAKGQPREPQVYTLPPSRD<br>ELTKNQVSLTCLVKGFYPSDIAVEWESNGQPENNYKTTPPVLDSD<br>GSFFLYSKLTVDKSRWQQGNVFSCSVMHEALHNHYTQKSLSLSP<br>GK |
| 20G2 | 275<br>(nucleotide<br>sequence light<br>chain) | GACATCCAGATGACCCAGTCTCCATCCACCCTGTCTGCATCTGT<br>AGGAGACCGTGTCACCATCACTTGCCGTGCCAGTCAGAGTATT<br>AGTAGCTGGTTGGCCTGGTATCAGCAGAAACCAGGGAAAGCC<br>CCTAAGCTCCTGATCTATGATGCCTCCAGTTTGGAAAGTGGGG<br>TCCCATCACGTTTCAGCGGCAGTGGATCCGGGACAGAATTCAC<br>TCTCACCATCAGCAGCTTGCAGCCTGATGATTTTGCAACTTATT<br>ACTGCCAACAGCAGCACTCGTATTATACGTTTGGCCAGGGCAC<br>CAAAGTCGAGATCAAGCGTACGGTGGCTGCACCATCTGTCTTC<br>ATCTTCCCGCCATCTGATGAGCAGTTGAAATCTGGAACTGCCT<br>CTGTTGTGTGCCTGCTGAATAACTTCTATCCCAGAGAGGCCAA<br>AGTACAGTGGAAGGTGGATAACGCCCTCCAATCGGGTAACTCC<br>CAGGAGAGTGTCACAGAGCAGGACAGCAAGGACAGCACCTAC<br>AGCCTCAGCAGCACCCTGACGCTGAGCAAAGCAGACTACGAG<br>AAACACAAAGTCTACGCCTGCGAAGTCACCCATCAGGGCCTGA<br>GCTCGCCCGTCACAAAGAGCTTCAACAGGGGAGAGTGT |
| | 276<br>(nucleotide<br>sequence heavy<br>chain) | CAGGTGCAATTGGTGCAGTCTGGGGCTGAGGTGAAGAAGCCTG<br>GGTCCTCGGTGAAGGTCTCCTGCAAGGCCTCCGGAGGCACATT<br>CAGCAGCTACGCTATAAGCTGGGTGCGACAGGCCCCTGGACAA<br>GGGCTCGAGTGGATGGGAGGGATCATCCCTATCTTTGGTACAG<br>CAAACTACGCACAGAAGTTCCAGGGCAGGGTCACCATTACTGC<br>AGACAAATCCACGAGCACAGCCTACATGGAGCTGAGCAGCCT<br>GAGATCTGAGGACACCGCCGTGTATTACTGTGCGAGATCTTAC<br>TACTGGGAATCTTACCCGTTCGACTACTGGGGCCAAGGGACCA<br>CCGTGACCGTCTCCAGCGCTAGCACCAAGGGCCCATCGGTCTT<br>CCCCCTGGCACCCTCCTCCAAGAGCACCTCTGGGGGCACAGCG<br>GCCCTGGGCTGCCTGGTCAAGGACTACTTCCCCGAACCGGTGA<br>CGGTGTCGTGGAACTCAGGCGCCCTGACCAGCGGCGTGCACAC<br>CTTCCCGGCTGTCCTACAGTCCTCAGGACTCTACTCCCTCAGCA<br>GCGTGGTGACCGTGCCCTCCAGCAGCTTGGGCACCCAGACCTA<br>CATCTGCAACGTGAATCACAAGCCCAGCAACACCAAGGTGGA<br>CAAGAAAGTTGAGCCCAAATCTTGTGACAAAACTCACACATGC<br>CCACCGTGCCCAGCACCTGAAGCTGCAGGGGGACCGTCAGTCT<br>TCCTCTTCCCCCCAAAACCCAAGGACACCCTCATGATCTCCCG<br>GACCCCTGAGGTCACATGCGTGGTGGTGGACGTGAGCCACGAA |

TABLE 45-continued

Sequences of anti-4-1BB clones in P329GLALA human IgG1 format

| Clone | SEQ ID No. | Sequence |
|---|---|---|
| | | GACCCTGAGGTCAAGTTCAACTGGTACGTGGACGGCGTGGAGG<br>TGCATAATGCCAAGACAAAGCCGCGGGAGGAGCAGTACAACA<br>GCACGTACCGTGTGGTCAGCGTCCTCACCGTCCTGCACCAGGA<br>CTGGCTGAATGGCAAGGAGTACAAGTGCAAGGTCTCCAACAA<br>AGCCCTCGGCGCCCCCATCGAGAAAACCATCTCCAAAGCCAAA<br>GGGCAGCCCCGAGAACCACAGGTGTACACCCTGCCCCCATCCC<br>GGGATGAGCTGACCAAGAACCAGGTCAGCCTGACCTGCCTGGT<br>CAAAGGCTTCTATCCCAGCGACATCGCCGTGGAGTGGGAGAGC<br>AATGGGCAGCCGGAGAACAACTACAAGACCACGCCTCCCGTG<br>CTGGACTCCGACGGCTCCTTCTTCCTCTACAGCAAGCTCACCGT<br>GGACAAGAGCAGGTGGCAGCAGGGGAACGTCTTCTCATGCTCC<br>GTGATGCATGAGGCTCTGCACAACCACTACACGCAGAAGAGCC<br>TCTCCCTGTCTCCGGGTAAA |
| | 277<br>(Light chain) | DIQMTQSPSTLSASVGDRVTITCRASQSISSWLAWYQQKPGKAPK<br>LLIYDASSLESGVPSRFSGSGSGTEFTLTISSLQPDDFATYYCQQQH<br>SYYTFGQGTKVEIKRTVAAPSVFIFPPSDEQLKSGTASVVCLLNNF<br>YPREAKVQWKVDNALQSGNSQESVTEQDSKDSTYSLSSTLTLSK<br>ADYEKHKVYACEVTHQGLSSPVTKSFNRGEC |
| | 278<br>(Heavy chain) | QVQLVQSGAEVKKPGSSVKVSCKASGGTFSSYAISWVRQAPGQG<br>LEWMGGIIPIFGTANYAQKFQGRVTITADKSTSTAYMELSSLRSED<br>TAVYYCARSYYWESYPFDYWGQGTTVTVSSASTKGPSVFPLAPS<br>SKSTSGGTAALGCLVKDYFPEPVTVSWNSGALTSGVHTFPAVLQS<br>SGLYSLSSVVTVPSSSLGTQTYICNVNHKPSNTKVDKKVEPKSCD<br>KTHTCPPCPAPEAAGGPSVFLFPPKPKDTLMISRTPEVTCVVVDVS<br>HEDPEVKFNWYVDGVEVHNAKTKPREEQYNSTYRVVSVLTVLH<br>QDWLNGKEYKCKVSNKALGAPIEKTISKAKGQPREPQVYTLPPSR<br>DELTKNQVSLTCLVKGFYPSDIAVEWESNGQPENNYKTTPPVLDS<br>DGSFFLYSKLTVDKSRWQQGNVFSCSVMHEALHNHYTQKSLSLS<br>PGK |

The anti-4-BB antibodies were produced by co-transfecting HEK293-EBNA cells with the mammalian expression vectors using polyethylenimine. The cells were transfected with the corresponding expression vectors in a 1:1 ratio ("vector heavy chain":"vector light chain").

For production in 500 mL shake flasks, 400 million HEK293 EBNA cells were seeded 24 hours before transfection. For transfection cells were centrifuged for 5 minutes at 210×g, and the supernatant was replaced by pre-warmed CD CHO medium. Expression vectors (200 μg of total DNA) were mixed in 20 mL CD CHO medium. After addition of 540 μL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% CO2 atmosphere. After the incubation, 160 mL of F17 medium was added and cells were cultured for 24 hours. One day after transfection 1 mM valproic acid and 7% Feed with supplements were added. After culturing for 7 days, the supernatant was collected by centrifugation for 15 minutes at 210×g. The solution was sterile filtered (0.22 μm filter), supplemented with sodium azide to a final concentration of 0.01% (w/v), and kept at 4° C.

Purification of antibody molecules from cell culture supernatants was carried out by affinity chromatography using Protein A as described above for purification of antigen Fc fusions.

The protein was concentrated and filtered prior to loading on a HiLoad Superdex 200 column (GE Healthcare) equilibrated with 20 mM Histidine, 140 mM NaCl solution of pH 6.0.

The protein concentration of purified antibodies was determined by measuring the OD at 280 nm, using the molar extinction coefficient calculated on the basis of the amino acid sequence. Purity and molecular weight of the antibodies were analyzed by CE-SDS in the presence and absence of a reducing agent (Invitrogen, USA) using a LabChipGXII (Caliper). The aggregate content of antibody samples was analyzed using a TSKgel G3000 SW XL analytical size-exclusion column (Tosoh) equilibrated in a 25 mM $K_2HPO_4$, 125 mM NaCl, 200 mM L-Arginine Monohydrocloride, 0.02% (w/v) $NaN_3$, pH 6.7 running buffer at 25° C.

Table 46 summarizes the yield and final content of the anti-4-BB P329G LALA IgG1 antibodies.

TABLE 46

Biochemical analysis of anti-4-BB P329G LALA IgG1 clones

| Clone | Yield [mg/l] | Monomer [%] | CE-SDS (non red) | CE-SDS (red) |
|---|---|---|---|---|
| 12B3 P329GLALA IgG1 | 4 | 98 | 98.6% (173 kDa) | 22.5% (29 kDa)<br>75.5% (64 kDa) |
| 25G7 P329GLALA IgG1 | 25 | 100 | 99.7% (181.6 kDa) | 76.8% (65 kDa)<br>23% (42 kDa) |
| 11D5 P329GLALA IgG1 | 9.7 | 98.7 | 99.6% (176 kDa) | tbd. |

TABLE 46-continued

Biochemical analysis of anti-4-BB P329G LALA IgG1 clones

| Clone | Yield [mg/l] | Monomer [%] | CE-SDS (non red) | CE-SDS (red) |
|---|---|---|---|---|
| 9B11 P329GLALA IgG1 | 22 | 100 | 100% (153 kDa) | 2% (127 kDa)<br>72.3% (114 kDa)<br>24.6% (37.1 kDa) |
| 20G2 P329GLALA IgG1 | 11 | 100 | 98.5% (166 kDa) | 80.2% (62.8 kDa)<br>18% (28.4 kDa) |

Example 7

Characterization of Anti-4-BB Antibodies 7.1 Binding on Human 4-1BB
7.1.1 Surface Plasmon Resonance (Avidity+Affinity)

Binding of phage-derived 4-1BB-specific antibodies to the recombinant 4-1BB Fc(kih) was assessed by surface plasmon resonance (SPR). All SPR experiments were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany).

In the same experiment, the species selectivity and the avidity of the interaction between the phage display derived anti-4-1BB clones 12B3, 25G7, 11D5, 9B11 and 20G2 (all human IgG1 P329GLALA), and recombinant 4-1BB (human, cyno and murine) was determined. Biotinylated human, cynomolgus and murine 4-1BB Fc(kih) were directly coupled to different flow cells of a streptavidin (SA) sensor chip. Immobilization levels up to 100 resonance units (RU) were used. Phage display derived anti-4-1BB human IgG1 P329GLALA antibodies were passed at a concentration range from 4 to 450 nM (3-fold dilution) with a flow of 30 µL/minute through the flow cells over 120 seconds. Complex dissociation was monitored for 220 seconds. Bulk refractive index differences were corrected for by subtracting the response obtained in a reference flow cell, where no protein was immobilized.

Kinetic constants were derived using the Biacore T200 Evaluation Software (vAA, Biacore AB, Uppsala/Sweden), to fit rate equations for 1:1 Langmuir binding by numerical integration and used to estimate qualitatively the avidity (Table 47).

In the same experiment, the affinities of the interaction between phage display derived antibodies (human IgG1 P329GLALA) to recombinant 4-1BB (human, cyno and murine) were determined. Anti-human Fab antibody (Biacore, Freiburg/Germany) was directly coupled on a CM5 chip at pH 5.0 using the standard amine coupling kit (Biacore, Freiburg/Germany). The immobilization level was approximately 7500 RU. Phage display derived antibodies to 4-1BB were captured for 60 seconds at concentrations ranging from 25 nM. Recombinant human 4-1BB Fc(kih) was passed at a concentration range from 4.1 to 1000 nM with a flow of 30 µL/minutes through the flow cells over 120 seconds. The dissociation was monitored for 120 seconds. Bulk refractive index differences were corrected for by subtracting the response obtained on reference flow cell. Here, the antigens were flown over a surface with immobilized anti-human Fab antibody but on which HBS-EP has been injected rather than the antibodies. Kinetic constants were derived using the Biacore T200 Evaluation Software (vAA, Biacore AB, Uppsala/Sweden), to fit rate equations for 1:1 Langmuir binding by numerical integration.

Clones 25G7 and 9B11 bind human 4-1BB Fc(kih) with a lower affinity than clones 12B3 and 11D5. Clone 20G2 is not binding to human 4-1BB. Affinity constants for the interaction between anti-4-1BB P329GLALA IgG1 and human 4-1BB Fc(kih) were determined by fitting to a 1:1 Langmuir binding.

TABLE 47

Binding of anti-4-1BB antibodies to recombinant human 4-1BB

| Clone | Origin | Recombinant human 4-1BB (avidity format) | Recombinant human 4-1BB (affinity format) | | |
|---|---|---|---|---|---|
| | | | ka (1/Ms) | kd (1/s) | KD (M) |
| 12B3 | Phage display | ++++ | 3.4E+04 | 1.0E−03 | 3.0E−08 |
| 25G7 | Phage display | + | 2.9E+04 | 9.9E−04 | 3.4E−08 |
| 11D5 | Phage display | +++ | 3.2E+04 | 1.2E−03 | 3.6E−08 |
| 9B11 | Phage display | ++ | 2.7E+04 | 3.9E−03 | 1.4E−07 |

7.1.2 Binding to Human 4-1BB Expressing Cells: Resting and Activated Human Peripheral Mononuclear Blood Leukocytes (PBMC)

Expression of human 4-1BB is absent on resting and naïve human T cells (Kienzle G. and von Kempis J (2000), Int. Immunol. 12(1), 73-82, Wen T. et al. (2002), J. Immunol. 168, 4897-4906). After activation with immobilized anti-human CD3 agonistic antibody, 4-1BB is upregulated on $CD4^+$ and $CD8^+$ T cells. 4-1BB expression has also been reported on activated human NK cells (Baessler T. et. al. (2010) Blood 115(15), 3058-3069), activated human NKT cells (Cole S. L. et al. (2014) J. Immunol. 192(8), 3898-3907), activated human B cells (Zhang et al. (2010) J. Immunol. 184(2), 787-795), activated human eosinophils (Heinisch et al. 2001), constitutively on human neutrophils (Heinisch I. V. (2000) J Allergy Clin Immunol. 108(1), 21-28), activated human monocytes (Langstein J. et al. (1998) J Immunol. 160(5), 2488-2494, Kwajah M. and Schwarz H. (2010) Eur J Immunol. 40(7), 1938-1949), constitutively on human regulatory T cells (Bacher P. et al. (2014) Mucosal Immunol. 7(4), 916-928), human follicular dendritic cells (Pauly S. et al. (2002) J Leukoc Biol. 72(1), 35-42), activated human dendritic cells (Zhang L. et al. (2004) Cell Mol Immunol. 1(1), 71-76) and on blood vessels of malignant human tumors (Broll K. et al. (2001) Am J Clin Pathol. 115(4), 543-549).

To test binding of our anti-4-1BB clones to naturally cell-expressed human 4-1BB, fresh isolated resting peripheral blood mononuclear cells (PBMCs) or PHA-L/Proleukin pre-activated and CD3/CD28-reactivated PBMC were used. PBMCs from buffy coats obtained from the Zurich blood donation center were isolated by ficoll density centrifugation using Histopaque 1077 (SIGMA Life Science, Cat.-No. 10771, polysucrose and sodium diatrizoate, adjusted to a density of 1.077 g/mL) and resuspended in T cell medium consisting of RPMI 1640 medium (Gibco by Life Technology, Cat.-No. 42401-042) supplied with 10% Fetal Bovine Serum (FBS, Gibco by Life Technology, Cat.-No. 16000-044, Lot 941273, gamma-irradiated, mycoplasma-free and heat inactivated at 56° C. for 35 min), 1% (v/v) GlutaMAX-I (GIBCO by Life Technologies, Cat.-No. 35050 038), 1 mM Sodium Pyruvate (SIGMA, Cat.-No. S8636), 1% (v/v) MEM non-essential amino acids (SIGMA, Cat.-No. M7145) and 50 µM β-Mercaptoethanol (SIGMA, M3148). PBMCs were used directly after isolation (resting cells) or stimulated to induce 4-1BB expression at the cell surface of T cells by culturing for 3 to 5 days in T cell medium supplemented with 200 U/mL Proleukin (Novartis Pharma Schweiz AG, CHCLB-P-476-700-10340) and 2 µg/mL PHA-L (SIGMA Cat.-No. L2769) in a 6-well tissue culture plate and then 2 day in a 6-well tissue culture plate coated with 10 µg/mL anti-human CD3 (clone OKT3, BioLegend, Cat.-No. 317315) and 2 µg/mL anti-human CD28 (clone CD28.2, BioLegend, Cat.-No.: 302928) in T cell medium at 37° C. and 5% $CO_2$.

To determine binding to human 4-1BB expressed by human PBMCs, $0.1$-$0.2 \times 10^6$ freshly isolated or activated PBMCs were added to each well of a round-bottom suspension cell 96-well plates (Greiner bio-one, cellstar, Cat.-No. 650185). Plates were centrifuged 4 minutes with 400×g at 4° C. and supernatant was discarded. Cells were washed with 200 µL/well DPBS and then incubated for 30 min at 4° C. with 100 µL/mL DPBS containing 1:5000 diluted Fixable Viability Dye eFluor 450 (eBioscience, Cat.-No. 64-0863-18) or Fixable Viability Dye eFluor 660 (eBioscience, Cat.-No. 65-0864-18). Afterwards cells were washed once with 200 µL/well cold FACS buffer (DPBS supplied with 2% (v/v) FBS, 5 mM EDTA pH8 (Amresco, Cat. No. E177) and 7.5 mM sodium azide (Sigma-Aldrich S2002)). Next, 50 µL/well of 4° C. cold FACS buffer containing titrated anti-human 4-1BB binders were added and cells were incubated for 120 minutes at 4° C. Cells were washed four times with 200 µL/well 4° C. FACS buffer to remove onbound molecules. Afterwards cells were further incubated with 50 µL/well of 4° C. cold FACS buffer containing 2.5 µg/mL PE-conjugated AffiniPure anti-human IgG Fcγ-fragment-specific goat F(ab')2 fragment (Jackson ImmunoResearch, Cat.-No. 109-116-098) or 30 µg/mL FITC-conjugated AffiniPure anti-human IgG Fcγ-fragment-specific goat F(ab')2 fragment (Jackson ImmunoResearch, Cat.-No. 109 096 098), anti-human CD45 AF488 (clone HI30, BioLegend, Cat.-No. 304019), 0.67 µg/mL APC/Cy7-conjugated anti-human CD3 moIgG1κ (clone UCH1, BioLegend, Cat.-No. 300426) or 0.125 µg/mL PE-conjugated anti-human CD3 mouse IgG1κ (clone SK7, BioLegend Cat.-No. 344806) or 0.67 µg/mL PerCP/Cy5.5-conjugated anti-human CD3 mouse IgG1 κ (clone UCHT1, BioLegend, Cat.-No. 300430), 0.125 µg/mL BV421-conjugated anti-human CD4 moIgG1κ (clone RPA-T4, BioLegend, Cat.-No. 300532) or 0.23 µg/mL BV421-conjugated anti-human CD4 mouse IgG2b κ (clone OKT4, BioLegend, Cat.-No. 317434) or 0.08 µg/mL PE/Cy7-conjugated anti-human CD4 mouse IgG1κ (clone SK3, BioLegend Cat.-No. 344612), 0.17 µg/mL APC/Cy7-conjugated anti-human CD8 (mouse IgG1κ, clone RPA-T8, BioLegend Cat.-No. 301016) or 0.125 µg/mL PE/Cy7-conjugated anti-human CD8a (moIgG1κ, clone RPA-T8, BioLegend, Cat.-No. 301012) or 0.33 µg/mL anti-human CD8 BV510 (moIgG1κ, clone SK1, BioLegend, Cat.-No. 344732) and 0.25 µg/mL APC-conjugated anti-human CD56 (mouse IgG1κ, clone HCD56, BioLegend, Cat.-No. 318310) or 1 µL AF488-conjugated anti-human CD56 (moIgG1κ, clone B159, BD Pharmingen, Cat.-No. 557699) and 0.67 µg/mL anti-human CD19-PE/Cy7 (moIgG1κ, clone HIB19, BioLegend, Cat.-No. 302216) and incubated for 30 minutes at 4° C.

Cells were washed twice with 200 µL FACS buffer/well and fixated by resuspending in 50 µL/well DPBS containing 1% Formaldehyde (Sigma, HT501320-9.5L). Cells were acquired the same or next day using a 3-laser Canto II (BD Bioscience with DIVA software) or a 5-laser Fortessa (BD Bioscience with DIVA software) or 3-laser MACSQuant Analyzer 10 (Miltenyi Biotech). Gates were set on $CD8^+$ and $CD4^+$ T cells and the median fluorescence intensity (MFI) or geo mean of fluorescence intensity of the secondary detection antibody was used to analyze binding of primary antibodies. Using Graph Pad Prism (Graph Pad Software Inc.) data was baselined by subtracting the blank values (no primary antibody added) and the EC50 values were calculated using non-linear regression curve fit (robust fit).

Human T cells lack 4-1BB expression in a resting status but upregulate 4-1BB after activation. Human $CD8^+$ T cells show a stronger up-regulation than $CD4^+$ T. The generated anti-human 4-1BB-specific antibodies can bind to human 4-1BB expressed by activated human T cells as shown in FIGS. 23A-23D. The shown anti-human 4-1BB clones can be classified in strong binding (clones 12B3 and 11D5) and low binders (clones 25G7 and 9B11). Differences are not only seen by $EC_{50}$ value but also by MFI. The $EC_{50}$ values of binding to activated CD8 T cells are shown in Table 48. The anti-mouse 4-1BB-specific clone 20G2 did not bind to human 4-1BB and is therefore not human-cross-reactive.

TABLE 48

| $EC_{50}$ values of binding to activated human CD8 T cells | |
|---|---|
| Clone | $EC_{50}$ [nM] |
| 25G7 | 29 |
| 12B3 | 0.95 |
| 11D5 | 1.46 |
| 9B11 | 4.485 |
| 20G2 | n.d. |

7.2 Binding on Murine 4-1BB
7.2.1 Surface Plasmon Resonance (Avidity+Affinity)

Binding of the phage-derived 4-1BB specific antibody 20G2 to recombinant murine 4-1BB Fc(kih) was assessed by surface plasmon resonance as described above for human 4-1BB Fc(kih) (see Example 7.1.1). Kinetic constants were derived using the Biacore T200 Evaluation Software (vAA, Biacore AB, Uppsala/Sweden), to fit rate equations for 1:1 Langmuir binding by numerical integration and used to estimate qualitatively the avidity (Table 44).

For affinity determination, due to an unspecific interaction of the Fc fusion protein to the reference flow cell, murine 4-1BB Fc(kih) was cleaved with AcTEV protease and the Fc portion removed by chromatographical method. Anti-human Fc antibody (Biacore, Freiburg/Germany) was directly coupled on a CM5 chip at pH 5.0 using the standard amine coupling kit (Biacore, Freiburg/Germany). The immobilization level was about 7500 RU. Phage display derived antibodies to 4-1BB were captured for 60 seconds at concentrations ranging from 25 nM. Recombinant murine 4-1BB AcTEV was passed at a concentration range from 4.1 to 1000 nM with a flow of 30 μL/minutes through the flow cells over 120 seconds. The dissociation was monitored for 120 seconds. Bulk refractive index differences were corrected for by subtracting the response obtained on reference flow cell. Here, the antigens were flown over a surface with immobilized anti-human Fc antibody but on which HBS-EP has been injected rather than the antibodies.

Kinetic constants were derived using the Biacore T200 Evaluation Software (vAA, Biacore AB, Uppsala/Sweden), to fit rate equations for 1:1 Langmuir binding by numerical integration. It was shown that clone 20G2 binds murine 4-1BB (Table 49).

Affinity constants of interaction between anti-4-1BB P329GLALA IgG1 molecules and murine 4-1BB were derived using the Biacore T200 Evaluation Software (vAA, Biacore AB, Uppsala/Sweden), to fit rate equations for 1:1 Langmuir binding by numerical integration.

TABLE 49

Binding of anti-4-1BB antibody 20G2 to murine 4-1BB

| Clone | Origin | Recombinant murine 4-1BB (avidity format) | Recombinant murine 4-1BB (affinity format) | | |
|---|---|---|---|---|---|
| | | | ka (1/Ms) | kd (1/s) | KD (M) |
| 20G2 | Phage display | +++++ | 2.4E+04 | 3.4E−04 | 1.4E−08 |

7.2.2 Binding to Mouse 4-1BB Expressing Cells: Resting and Activated Mouse Splenocytes (Selected Clones)

Similar to human, freshly isolated resting mouse T cells do not express 4-1BB but expression can be induced by TCR activation via peptide-pulsed APCs (Cannons J. et al. (2001) J. Immunol. 167(3): 1313-1324) or immobilized anti-mouse CD3 or a combination of anti-mouse CD3 and anti-mouse CD28 antibodies (Pollok K. et al. (1995), European J. Immunol. 25(2), 488-494). After activation via surface immobilized anti-CD3 antibody 4-1BB expression is reported to be higher on $CD8^+$ T cells (Shuford W, et al. (1997) J. of Experimental Med. 186(1), 47-55), but this may depend on activation protocol. Further 4-1BB expression has also been reported on activated mouse NK cells (Melero et al. (1998) Cell Immunol. 190(2), 167-172), activated mouse NKT cells (Vinay D, et al. (2004) J Immunol. 173(6), 4218-4229), activated mouse B cells (Vinay, Kwon (2011) Cell Mol Immunol. 8(4), 281-284), constitutively on mouse neutrophils (Lee S. et al. (2005) Infect Immun. 73(8), 5144-5151) and mouse regulatory T cells (Gavin et al. (2002) Nat Immunol. 3(1), 33-41), mouse IgE-stimulated mast cell (Nishimoto et al. (2005) Blood 106(13): 4241-4248), mouse myeloid-lineage cells (Lee et al. (2008) Nat Immunol. 9(8), 917-926), mouse follicular dendritic cells (Middendorp et al. (2009) Blood 114(11), 2280-2289) and activated mouse dendritic cells (Wilcox, Chapoval et al. (2002) J Immunol. 168(9),4262-4267).

Anti-4-1BB specific antibody binding was tested directly after isolation of splenocytes from healthy female C57BL/6 mice as well as after in vitro activation for 72 hours with surface immobilized agonistic anti-mouse CD3 and anti-mouse CD28 antibodies. Female C57BL/6 mice (age 7-9 weeks) were purchased at Charles River, France. After arrival animals were maintained for one week to get accustomed to new environment and for observation. Mice were maintained under specific-pathogen-free condition with food and water ad libitum and daily cycles of 12 h light/12 h darkness according to committed guidelines (GV-Solas; Felasa; TierschG). Continuous health monitoring was carried out on a regular basis. Mice were sacrificed by cervical dislocation. Spleens were dissected and stored on ice in RPMI 1640 supplemented with 10% (v/v) heat-inactivated FBS and 1% (v/v) GlutaMAX-I. To obtain a single cell solution spleens were homogenized through a 70 μm cell strainer (BD Falcon; Germany) and subjected to erythrolysis for 10 minutes at 37° C. in ACK lysis buffer (0.15M $NH_4CL$, 10 mM $KHCO_3$, 0.1 mM EDTA in $ddH_2O$, pH 7.2). After two washing steps with sterile DPBS splenocytes were reconstituted in T cell medium. Either cells were used freshly (resting) or $10^6$ cells/mL splenocytes were further stimulated for 72 hours in T cell medium consisting of RPMI 1640 medium supplied with 10% FBS, 1% (v/v) GlutaMAX-I, 1 mM Sodium Pyruvate, 1% (v/v) MEM non-essential amino acids and 50 μM β-Mercaptoethanol on 6-well cell culture plates coated with 1 μg/mL anti-mouse CD3 antibody (rat IgG2b, clone 17A2, BioLegend, Cat.-No. 100223) and 2 μg/mL anti-mouse CD28 antibody (syrian hamster, clone 37.51, BioLegend Cat.-No. 102112).

To test binding to mouse 4-1BB, freshly isolated or activated mouse splenocytes were resuspended in DPBS and $0.1 \times 10^6$/well splenocytes were transferred to a round-bottom 96-suspension cell plate (Greiner bio-one, cellstar, Cat.-No. 650185). Cells were centrifuged 4 minutes at 4° C. and 400×g and supernatant was removed. After resuspension in 100μ/well DPBS containing 1:5000 diluted Fixable Viability Dye eFluor 450 (eBioscience, Cat.-No. 65-0863-18) or Fixable Viability Dye eFluor 660 (eBioscience, Cat.-No. 65-0864-18) cells were incubated for 30 min at 4° C. Cells were washed with FACS buffer and 50 μL/well FACS buffer containing titrated concentrations of anti-human 4-1BB huIgG1 P329G LALA antibody-clones 12B3, 25G7, 11D5, 9B11 and anti-mouse 4-1BB-specific clone 20G2 as huIgG1 P329G LALA or mouse IgG1 or mouse IgG1 DAPG. After 1 h incubation at 4° C. cells were washed four times to remove excessive antibodies. If binding of anti-mouse 20G2 as mouse IgG1 and mouse IgG1 DAPG format was tested, cells were incubated in 50 μL FACS buffer/well containing 30 μg/mL FITC-conjugated anti-mouse IgG Fcγ-fragment-specific AffiniPure goat F(ab')γ fragment for 30 min at 4° C. and washed twice with FACS-buffer. If binding of anti-4-1BB binders containing a human IgG1 P329G LALA Fc-fragment were tested this step was skipped. Afterwards cells were incubated in 50 μL FACS buffer/well containing 0.67 μg/mL PE-conjugated anti-mouse CD3 (rat IgG2bκ, clone 17A2, BD Pharmingen, Cat.-No. 555275) or APC-Cy7-conjugated anti-mouse CD3 (rat IgG2aκ, clone 53-6.7, BioLegend, Cat.-No. 100708), 0.67 μg/mL PE/Cy7-conjugated anti-mouse CD4 (rat IgG2bκ, clone GK1.5, BioLegend, Cat.-No. 100422), 0.67 μg/mL APC/Cy7-conjugated anti-mouse CD8 (rat IgG2aκ, clone 53-6.7, BioLegend, Cat.-No. 1007141) or PE-conjugated anti-mouse CD8 (rat IgG2aκ, clone 53-6.7, BioLegend, Cat.-No. 100708), 2 μg/mL APC-conjugated anti-mouse NK1.1 (mouse IgG2a, κ, clone PK136, BioLegend, Cat.-No. 108710) or PerCP/Cy5.5-conjugated anti-mouse NK1.1 (mouse IgG2a, κ, clone PK136, BioLegend, Cat.-No. 108728) and 10 μg/mL anti-mouse CD16/CD32 (mouse Fc-Block, rat IgG2b κ, clone 2.4G2, BD Bioscience, Cat.-No. 553142). If binding of anti-4-1BB binders containing a human IgG1 P329G LALA Fc-fragment were tested 30 μg/mL FITC-conjugated AffiniPure anti-human IgG Fcγ-fragment-specific goat F(ab')2 fragment (Jackson ImmunoResearch, Cat. No. 109 096 098) were also added. Cells were incubated for 30 min at 4° C., washed twice with 200

µL/well FACS-buffer and resuspended for fixation with 50 µL/well DPBS containing 1% (v/v) formaldehyde. The next day cells were resuspended in 200 µL/well FACS buffer and acquired using the 2-laser CantoII (BD Bioscience with DIVA software) or 5-laser Fortessa (BD Bioscience with DIVA software). Gates were set on CD8$^+$ and CD4$^+$ T cells and the median fluorescence intensity (MFI) of the secondary detection antibody was used to analyze binding of primary antibodies. Using Graph Pad Prism (Graph Pad Software Inc.) data was baselined by subtracting the blank values (no primary antibody added) and the EC$_{50}$ values were calculated using non-linear regression curve fit (robust fit).

Figure 24A:
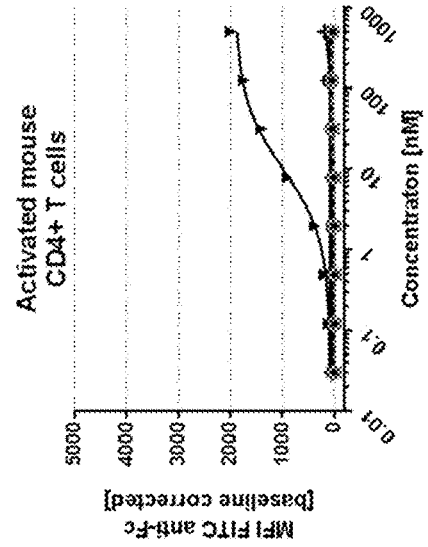
FIGS. 24A, 24B, 24C and 24D show the binding to 4-1BB expressing mouse T cells. Shown is the binding to resting and activated mouse T cells of four anti-human 4-1BB binding huIgG1 P329G LALA antibody clones (filled diamond: clone 25G7, filled square: clone 12B3, filled star: clone 11D5, pointing-up triangle: clone 9B11) and one anti-mouse 4-1BB binding huIgG1 P329G LALA antibody clone 20G2 (pointing-down triangle). As negative control a non-4-1BB binding DP47 huIgG1 P329G LALA antibody was used (open grey circle). The upper panels show binding to resting mouse CD4+ T cells (FIG. 24A) and activated CD4+ T cells (FIG. 24B), whereas the lower panels show binding to resting mouse CD8+ T cells (FIG. 24C) and activated CD8+ T cells (FIG. 24D). The binding is characterized by plotting the MFI of FITC-labeled anti-human IgG Fcγ-specific goat IgG F(ab')$_2$ fragment that is used as secondary detection antibody versus the concentration in nM of the tested primary anti-4-1BB-binding huIgG1 P329G LALA antibodies. MFI was measured by flow cytometry and baseline corrected by subtracting the MFI of the blank control (no primary antibody).
Figure 24B:
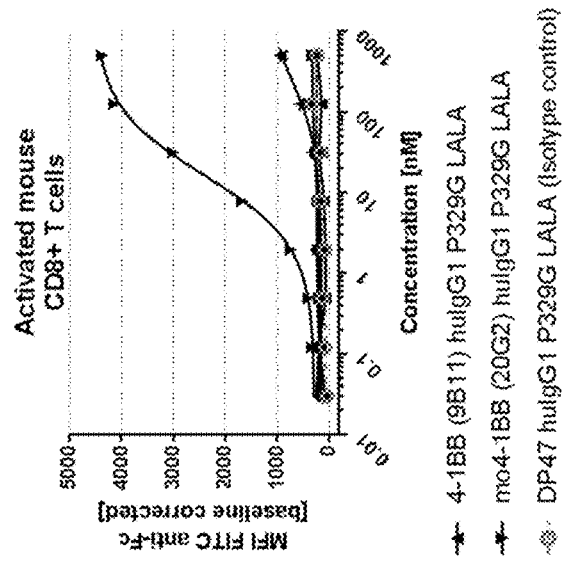
Figure 24C:
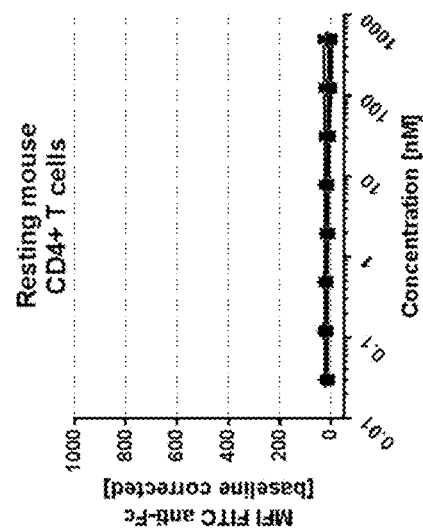
Figure 24D:
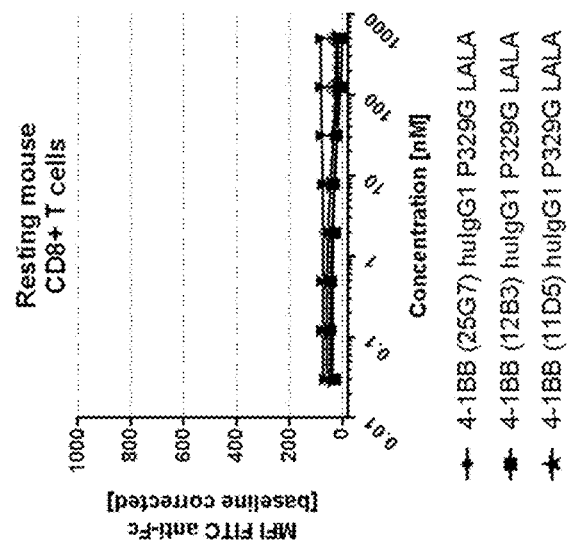
Figure 28A:
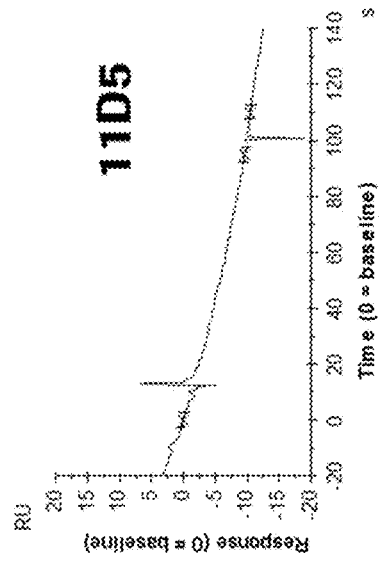
Figure 28B:
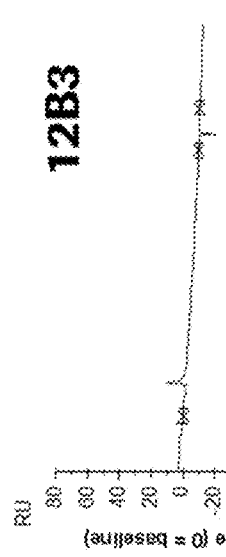
Figure 28C:
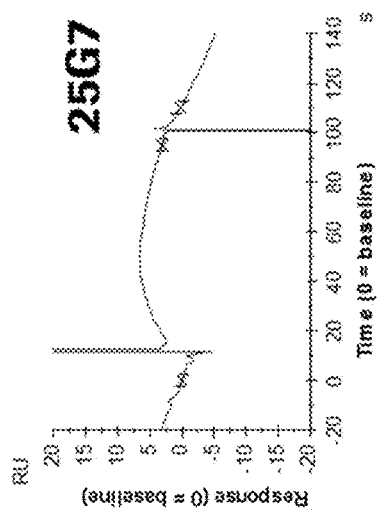
Figure 29B:
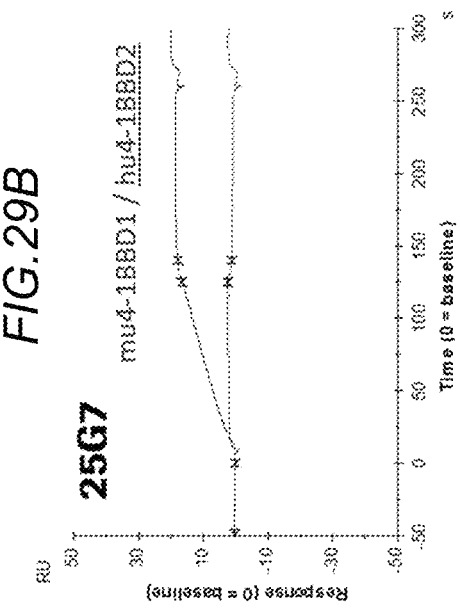
FIGS. 29A, 29B, 29C and 29D show the binding of hybrid 4-1BB Fc(kih) variants to anti-4-1BB antibodies, i.e. binding of hu4-1BBD1/mu4-1BBD2-Fc(kih) and mu4-1BBD1/hu4-1BBD2-Fc(kih) variants to anti-4-1BB antibodies. Underlined is the 4-1BB domain recognized by the antibody.
Figure 29D:
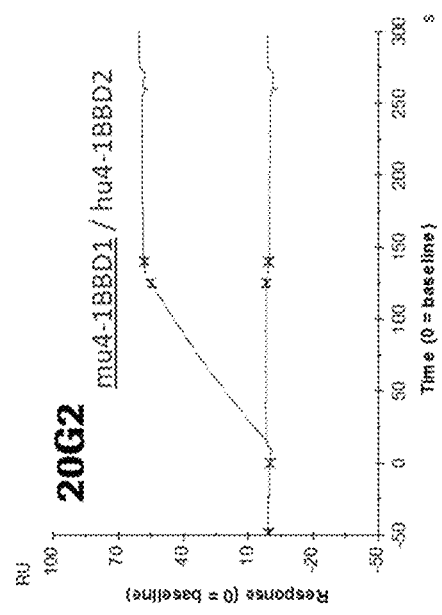
Figure 29A:
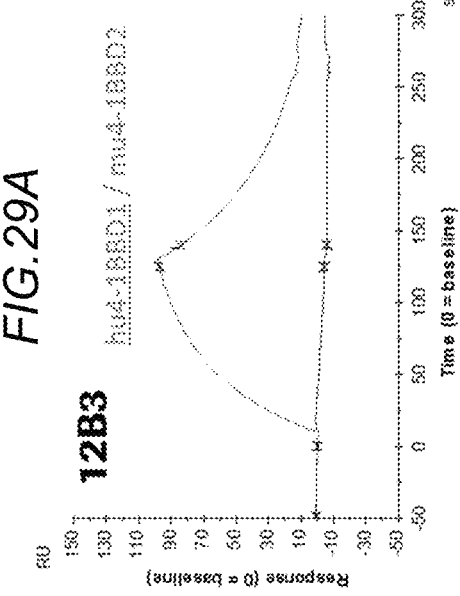
Figure 29C:
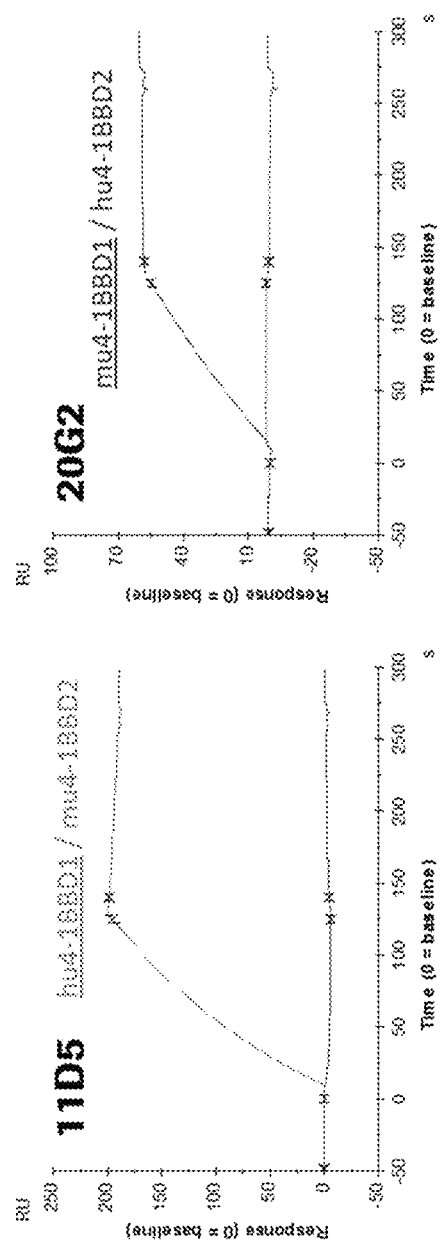
Figure 30A:
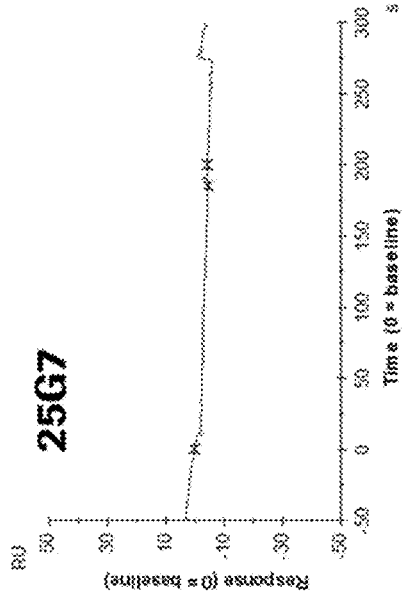
FIGS. 30A, 30B, 30C and 30D show the binding of anti-human 4-1BB antibodies 11D5, 12B3, 25G7 and 9B11 to human 4-1BB Domain 1. Anti-human 4-1BB antibodies 11D5, 12B3 and 9B11 bind human domain 1 containing 4-1BB constructs.
Figure 30B:
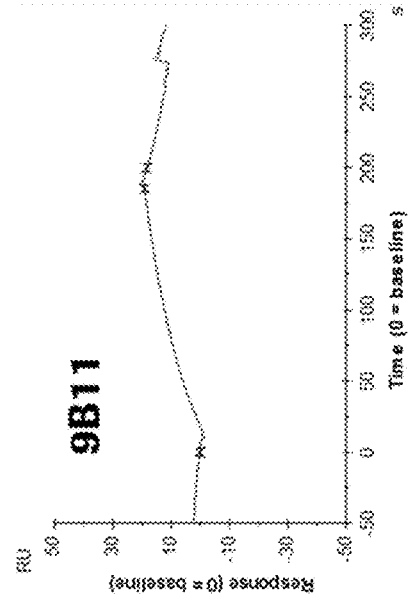
Figure 30C:
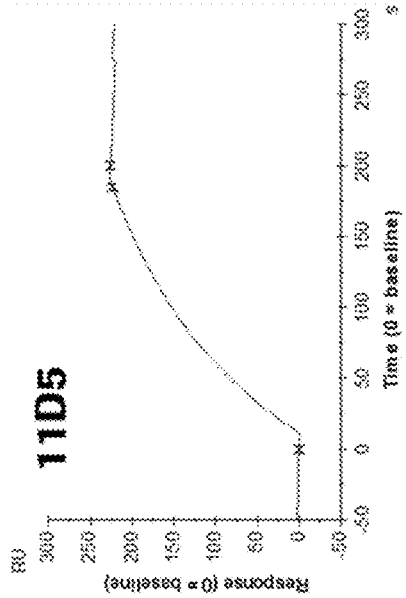
Figure 30D:
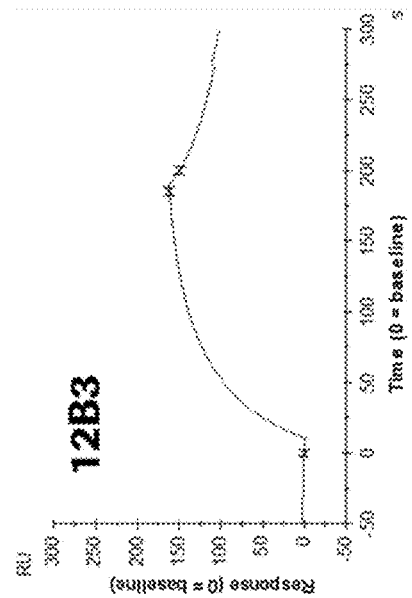

As shown in FIGS. 24B and 24D, only the anti-mouse 4-1BB binding clone 20G2 bound to activated mouse CD8$^+$ and CD4$^+$ T cells, whereas the anti-human-4-1BB binding clones 9B11, 11D5, 12B3 and 25G7 did not bind to mouse-4-1BB and are therefore not mouse-cross-reactive. Only clone 20G2 from the tested clones can be used as a mouse surrogate. As expected none of the anti-4-1BB binding clones showed binding to freshly isolated resting mouse T cells (FIGS. 24A and 24C). Similar to the activated human CD4$^+$ T cells also the activated mouse CD4$^+$ T cells express less 4-1BB than the activated mouse CD8$^+$ T cells. The difference however is not as strong as for human T cells, this may also be related to the different activation protocol. EC$_{50}$ values are shown in Table 50.

TABLE 50

EC$_{50}$ values of binding to activated murine CD8 and CD4 T cells

| Clone | EC$_{50}$ CD8 [nM] | EC$_{50}$ CD4 [nM] |
|---|---|---|
| 25G7 | n.d. | n.d. |
| 12B3 | n.d. | n.d. |
| 11D5 | n.d | n.d |
| 9B11 | n.d | n.d |
| 20G2 | 16.36 | 10.10 |

As shown in FIGS. 25B and 25D, the anti-mouse-4-1BB binding clone 20G2 binds to activated mouse CD8$^+$ and CD4$^+$ T cells as moIgG1 wildtype (wt) or moIgG1 DAPG format in a similar way. The binding is similar to the binding shown in FIGS. 24B and 24D; therefore changing of format does not influence the binding properties. We transferred the clone 20G2 to moIgG to prevent triggering of anti-drug-antibodies (ADAs) in immune competent mice. The DAPG mutation is equivalent to the P329G LALA mutation in the human IgG1 constructs, e.g. it prevents crosslinking via the FcR$^+$ immune cells. EC50 values are shown in Table 51.

TABLE 51

EC$_{50}$ values of binding to activated murine CD8 and CD4 T cells

| Clone | EC$_{50}$ CD8 [nM] | EC$_{50}$ CD4 [nM] |
|---|---|---|
| 20G2 mu IgG1 κ DAPG | 17.91 | 11.22 |
| 20G2 mu IgG1 κ wt | 18.51 | 9.917 |

7.3 Binding on Cynomolgus 4-1BB
7.3.1 Surface Plasmon Resonance (Avidity+Affinity)

Binding of phage-derived 4-1BB specific antibodies 12B3, 25G7, 11D5 and 9B11 to the recombinant cynomolgus 4-1BB Fc(kih) was assessed by surface plasmon resonance (SPR) as described above for human 4-1BB Fc(kih) (see Example 7.1.1). All SPR experiments were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany). Kinetic constants were derived using the Biacore T200 Evaluation Software (vAA, Biacore AB, Uppsala/Sweden), to fit rate equations for 1:1 Langmuir binding by numerical integration and used to estimate qualitatively the avidity (Table 52).

In the same experiment, the affinities of the interaction between phage display derived antibodies (human IgG1 P329GLALA) to recombinant cynomolgus 4-1BB Fc(kih) were determined. Anti-human Fab antibody (Biacore, Freiburg/Germany) was directly coupled on a CM5 chip at pH 5.0 using the standard amine coupling kit (Biacore, Freiburg/Germany). The immobilization level was approximately 9000 RU. Phage display derived antibodies to 4-1BB were captured using concentrations of 25 to 100 nM. The experiment was performed as described for human 4-1BB Fc(kih) (Example 7.1.1).

Clones 12B3, 25G7, 11D5 and 9B11 bound cynomolgus 4-1BB Fc(kih) with similar affinities (Table 52), but 12B3 and 11D5 bound with higher avidity to cells expressing cynomolgus 4-1BB. Affinity constants of interaction between anti-4-1BB P329GLALA IgG1 and cynomolgus 4-1BB Fc(kih) were derived using the Biacore T100 Evaluation Software (vAA, Biacore AB, Uppsala/Sweden), to fit rate equations for 1:1 Langmuir binding by numerical integration.

TABLE 52

Binding of anti-4-1BB antibodies to recombinant cynomolgus 4-1BB Fc(kih)

| | | Recombinant cynomolgus 4-1BB (avidity format) | Recombinant cynomolgus 4-1BB (affinity format) | | |
|---|---|---|---|---|---|
| Clone | Origin | | ka (1/Ms) | kd (1/s) | KD (M) |
| 12B3 | Phage display | +++ | 3.8E+04 | 7.8E−04 | 2.0E−08 |
| 25G7 | Phage display | ++ | 2.7E+04 | 4.6E−04 | 1.7E−08 |
| 11D5 | Phage display | +++ | 3.1E+04 | 7.7E−04 | 2.4E−08 |
| 9B11 | Phage display | + | 2.6E+04 | 2.0E−03 | 7.8E−08 |

7.3.2 Binding on Cynomolgus 4-1BB Expressing Cells: Activated Cynomolgus Peripheral Mononuclear Blood Leukocytes (PBMC)

To test the cross-reactivity of the anti-human 4-1BB binding clones to cynomolgus cells, PBMCs of healthy cynomolgus *fascicularis* were isolated from heparinized blood using density gradient centrifugation as described for human PBMCs (7.1.2) with minor differences. Isolated PBMC were cultured for 72 hours at a cell density of 1.5*10$^6$ cells/mL in T cell medium consisting of RPMI 1640 medium supplied with 10% FBS, 1% (v/v) GlutaMAX-I, 1 mM Sodium Pyruvate, 1% (v/v) MEM non-essential amino acids and 50 µM β-Mercaptoethanol on 6-well cell culture plates (Greiner Bio-One, Germany) coated with 10 µg/mL anti-cyno-cross-reactive CD3 (mo IgG3λ, anti-human CD3, clone SP34, BD Pharmingen, Cat.-No. 556610) and 2 µg/mL anti-cyno-cross-reactive CD28 (moIgG1κ, anti-human CD28, clone CD28.2, BioLegend, Cat.-No. 140786) antibodies. After 72 h stimulation cells were harvested and seeded to a round-bottom suspension cell 96-well plate (Greiner bio-one, cellstar, Cat.-No. 650185) at a concentration of 0.1×10$^6$ cells/well. Cells were incubated in 50

µL/well FACS buffer containing different concentrations of the primary anti-human 4-1BB-specific huIgG P32G LALA antibodies for 2 h at 4° C. Afterwards cells were washed four times with 200 µL/well FACS buffer and incubated further for 30 min at 4° C. with 50 µL/well FACS buffer containing 2 µL PE-conjugated anti-cyno-crossreactive CD4 (moIgG2aκ, anti-human CD4, clone M-T477, BD Pharmingen, Cat.-No. 556616), 1 µg/mL PerCP/Cy5.5-conjugated anti-cyno-cross-reactive CD8 (moIgG1κ, anti-human CD8, clone RPA-T8, BioLegend, Cat.-No. 301032) and 30 µg/mL FITC-conjugated AffiniPure anti-human IgG Fcγ-fragment-specific goat F(ab')2 fragment (Jackson ImmunoResearch, Cat. No. 109 096 098). Cells were washed twice with FACS buffer and resuspended in 100 µL/well FACS buffer supplied with 0.2 µg/mL DAPI to discriminated dead from living cells. Cells were immediately acquired using a 5-laser Fortessa (BD Bioscience with DIVA software). Gates were set on CD8$^+$ and CD4$^+$ T cells and the median fluorescence intensity (MFI) of the secondary detection antibody was used to analyze binding of primary antibodies. Using Graph Pad Prism (Graph Pad Software Inc.) data was baselined by subtracting the blank values (no primary antibody added) and the $EC_{50}$ values were calculated using non-linear regression curve fit (robust fit).

As shown in FIGS. 26A and 26B, at least three of the anti-human 4-1BB clones, namely 12B3, 11D5 and 25G7 are also cross-reactive for cynomolgus 4-1BB expressed on activated CD4$^+$ and CD8$^+$ T cells. Interestingly the binding curves look similar to human 4-1BB, e.g. 12B3 and 11D5 show the highest MFI and lowest $EC_{50}$ values of all tested constructs, whereas 25G7 is a weaker binder with lower MFI and higher $EC_{50}$ value (Table 53). The clone 9B11 is only binding at the highest concentration of 100 nM. This is contrary to binding to human 4-1BB where clone 9B11 is superior compared to clone 25G7. Further differences of 4-1BB expression levels on activated cynomolgus CD4$^+$ and CD8$^+$ T cells are similar to activated human T cells e.g. CD4$^+$ T cells express much less 4-1BB than CD8$^+$ T cells.

TABLE 53

$EC_{50}$ values of binding to activated cynomolgus CD8 and CD4 T cells

| Clone | $EC_{50}$ CD8 [nM] | $EC_{50}$ CD4 [nM] |
|---|---|---|
| 25G7 | 4.52 | 6.68 |
| 12B3 | 0.47 | 0.59 |
| 11D5 | 1.04 | 0.97 |
| 9B11 | n.d. | n.d. |

7.4 Ligand Blocking Property

To determine the capacity of 4-1BB-specific human IgG1 P329GLALA antibody molecules to interfere with 4-1BB/4-1BB-ligand interactions human 4-1BB ligand (R&D systems) was used. Similarly, murine 4-1BB ligand (R&D systems) was used to assess the ligand blocking property of the anti-murine 4-1BB specific IgG1 P329GLALA antibody 20G2.

Human or murine 4-1BB ligand was directly coupled to two flow cells of a CM5 chip at approximately 1500 RU by pH 5.0 using the standard amine coupling kit (Biacore, Freiburg/Germany). Recombinant human, or murine, 4-1BB Fc(kih) was passed on the second flow cell at a concentration of 500 nM with a flow of 30 µL/minute over 90 seconds. The dissociation was omitted and the phage derived anti-4-1BB human IgG1 P329GLALA was passed on both flow cells at a concentration of 200 nM with a flow of 30 uL/minute over 90 seconds. The dissociation was monitored for 60 seconds. Bulk refractive index differences were corrected for by subtracting the response obtained on reference flow cell. Here, the antibodies were flown over a surface with immobilized human, or murine, 4-1BB ligand but on which HBS-EP has been injected instead of recombinant human 4-1BB Fc(kih).

The phage-derived clone 25G7 bound to the complex of human 4-1BB with its 4-1BB ligand (Table 54, FIG. 27A). Thus, this antibody does not compete with the ligand for binding to human 4-1BB and is therefore termed "non-ligand blocking". On the contrary, clones 12B3, 11D5 and 9B11 did not bind to human 4-1BB associated with its ligand and are therefore termed "ligand blocking". The murine surrogate 20G2 did not bind to murine 4-1BB associated with its ligand and is also termed "ligand blocking"

TABLE 54

Ligand binding property of the anti-4-1BB clones determined by surface plasmon resonance

| Clone | Origin | First injection | Second injection (anti-4-1BB clone) | Ligand blocking |
|---|---|---|---|---|
| 12B3 | Phage display | human 4-1BB Fc(kih) | Not binding | YES |
| 25G7 | Phage display | human 4-1BB Fc(kih) | Binding | NO |
| 11D5 | Phage display | human 4-1BB Fc(kih) | Not binding | YES |
| 9B11 | Phage display | human 4-1BB Fc(kih) | Not binding | YES |
| 20G2 | Phage display | murine 4-1BB Fc(kih) | Not binding | YES |

7.5 Epitope Characterization

The epitope recognized by the phage-derived anti-4-1BB antibody was characterized by surface plasmon resonance. First, the ability of the antibodies to compete for binding to human 4-1BB was assessed by surface plasmon resonance. Second, the binding of the anti-4-1BB antibodies to two different domains of human and murine 4-1BB was evaluated by SPR as described herein before. For this purpose hybrid 4-1BB Fc(kih) fusion proteins have been designed. They contain the ectodomains of 4-1BB either a human or a murine domain. The hybrid 4-1BB variants were fused to the knob chain of the Fc(kih), similarly to the antigens Fc fusion used for the phage display selection and described above. The aim of these experiments was to define an "epitope bin". Antibodies that compete for a similar or an overlapping epitope are not able to bind simultaneously to 4-1BB and belong to an "epitope bin". Anti-4-1BB antibodies that can bind simultaneously to 4-1BB do not share an epitope, or part of it, and are therefore grouped into a different epitope bin.

7.5.1 Competition Binding (SPR)

To analyze competitive binding for human or murine receptor of the anti-4-1BB human IgG1 P329GLALA (FIGS. 28A-28F), the phage derived anti-4-1BB clones 9B11 and 11D5 were directly coupled to CM5 chip at respectively 1400 and 2200 RU by pH 5.5 using the standard amine coupling kit (Biacore, Freiburg/Germany). Recombinant human 4-1BB Fc(kih) was injected at a concentration of 200 nM with a flow of 30 µL/min over 180 seconds. The dissociation was omitted and a second anti-4-1BB human IgG1 P329GLALA antibody was passed at a concentration of 100 nM with a flow of 30 µL/min over 90 seconds. Bulk refractive index differences were corrected for by subtracting the response obtained on reference flow cell.

The SPR experiments were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany). The competition binding experiment showed that the phage-derived anti-4-1BB clones 12B3, 11D5 and 9B11 shares a different spatial epitope as 25G7, since the two antibodies can bind simultaneously to human 4-1BB Fc(kih) (Table 55).

TABLE 55

Summary of competition binding experiments

| Immobilized on chip | First injection | Second injection | | | |
|---|---|---|---|---|---|
| | | 25G7 | 12B3 | 9B11 | 11D5 |
| 9B11 | Human 4-1BB Fc(kih) | 1 | 0 | X | 0 |
| 11D5 | Human 4-1BB Fc(kih) | 1 | 0 | 0 | X |

0 = no binding;
1, binding;
X = not determined since the second injection contains the same antibody as the one immobilized on the chip

7.5.2 Binding to Receptor Variants (SPR)

The epitopes recognized by the phage-derived anti-4-1BB clones 12B3, 25G7, 11D5, 9B11 and 20G2 have been characterized using hybrid variants of 4-1BB Fc(kih) fusion molecules containing a combination of human and murine domains, or a single domain (Table 56). The hybrid 4-1BB were fused to Fc(kih) as described in Example 6.1 for the 4-1BB Fc(kih) antigens. Table 52 contains the sequences of the 4-1BB domains used for the preparation of hybrid 4-1BB variants.

Construct 1 is composed by the N-terminal portion (termed domain 1) of murine 4-1BB fused to the C-terminal portion (termed domain 2) of human 4-1BB (Table 56). Construct 2 is composed by the N-terminal portion (termed domain 1) of human 4-1BB fused to the C-terminal portion (termed domain 2) of murine 4-1BB (Table 57). These hybrid molecules were prepared since the expression of domain 2 did not lead to a functional molecule. The N-terminal portion (domain 1) of human 4-1BB was also expressed as Fc(kih) fusion molecule (construct 3). Expression and purification of the hybrid 4-1BB Fc(kih) variants was performed as described in Example 6.1.

TABLE 56

Amino acid sequences of hybrid 4-1BB Fc(kih) molecules

| | Domains fused (SEQ ID NO:) | Amino acid sequence |
|---|---|---|
| Construct 1 | mu4-1BB D1/ hu4-1BB D2 Fc knob (279) | VQNSCDNCQPGTFCRKYNPVCKSCPPSTFSSIGGQPNCNIC RVCAGYFRFKKFCSSTHNAECECIEGFHCLGPQCTRCEKD CRPGQELTKQGCKDCCFGTFNDQKRGICRPWTNCSLDGK SVLVNGTKERDVVCGPSPADLSPGASSVTPPAPAREPGHS PQVDEQLYFQGGSPKSADKTHTCPPCPAPELLGGPSVFLF PPKPKDTLMISRTPEVTCVVVDVSHEDPEVKFNWYVDGV EVHNAKTKPREEQYNSTYRVVSVLTVLHQDWLNGKEYK CKVSNKALPAPIEKTISKAKGQPREPQVYTLPPCRDELTK NQVSLWCLVKGFYPSDIAVEWESNGQPENNYKTTPPVLD SDGSFFLYSKLTVDKSRWQQGNVFSCSVMHEALHNHYT QKSLSLSPGKSGGLNDIFEAQKIEWHE |
| | Fc hole (128) | DKTHTCPPCPAPEAAGGPSVFLFPPKPKDTLMISRTPEVTC VVVDVSHEDPEVKFNWYVDGVEVHNAKTKPREEQYNST YRVVSVLTVLHQDWLNGKEYKCKVSNKALGAPIEKTISK AKGQPREPQVCTLPPSRDELTKNQVSLSCAVKGFYPSDIA VEWESNGQPENNYKTTPPVLDSDGSFFLVSKLTVDKSRW QQGNVFSCSVMHEALHNRFTQKSLSLSPGK |
| Construct 2 | hu4-1BB D1/ mu4-1BB D2 Fc knob (280) | LQDPCSNCPAGTFCDNNRNQICSPCPPNSFSSAGGQRTCDI CRQCKGVFRTRKECSSTSNAECDCTPGFHCLGAGCSMCE QDCKQGQELTKKGCKTCSLGTFNDQNGTGVCRPWTNCS LDGRSVLKTGTTEKDVVCGPPVVSFSPSTTISVTPEGGPGG HSLQVLVDEQLYFQGGSPKSADKTHTCPPCPAPELLGGPS VFLFPPKPKDTLMISRTPEVTCVVVDVSHEDPEVKFNWY VDGVEVHNAKTKPREEQYNSTYRVVSVLTVLHQDWLNG KEYKCKVSNKALPAPIEKTISKAKGQPREPQVYTLPPCRD ELTKNQVSLWCLVKGFYPSDIAVEWESNGQPENNYKTTP PVLDSDGSFFLYSKLTVDKSRWQQGNVFSCSVMHEALHN HYTQKSLSLSPGKSGGLNDIFEAQKIEWHE |
| | Fc hole (128) | DKTHTCPPCPAPEAAGGPSVFLFPPKPKDTLMISRTPEVTC VVVDVSHEDPEVKFNWYVDGVEVHNAKTKPREEQYNST YRVVSVLTVLHQDWLNGKEYKCKVSNKALGAPIEKTISK AKGQPREPQVCTLPPSRDELTKNQVSLSCAVKGFYPSDIA VEWESNGQPENNYKTTPPVLDSDGSFFLVSKLTVDKSRW QQGNVFSCSVMHEALHNRFTQKSLSLSPGK |
| Construct 3 | hu4-1BB D1 Fc knob (281) | LQDPCSNCPAGTFCDNNRNQICSPCPPNSFSSAGGQRTCDI CRQCKGVFRTRKECSSTSNAECDCTPGFHCLGAGCSMCE QDCKQGQELTKKGCKVDEQLYFQGGSPKSADKTHTCPPC PAPELLGGPSVFLFPPKPKDTLMISRTPEVTCVVVDVSHED PEVKFNWYVDGVEVHNAKTKPREEQYNSTYRVVSVLTV LHQDWLNGKEYKCKVSNKALPAPIEKTISKAKGQPREPQ VYTLPPCRDELTKNQVSLWCLVKGFYPSDIAVEWESNGQ |

TABLE 56-continued

Amino acid sequences of hybrid 4-1BB Fc(kih) molecules

| Domains fused (SEQ ID NO:) | Amino acid sequence |
|---|---|
| Fc hole (128) | PENNYKTTPPVLDSDGSFFLYSKLTVDKSRWQQGNVFSC SVMHEALHNHYTQKSLSLSPGKSGGLNDIFEAQKIEWHE DKTHTCPPCPAPEAAGGPSVFLFPPKPKDTLMISRTPEVTC VVVDVSHEDPEVKFNWYVDGVEVHNAKTKPREEQYNST YRVVSVLTVLHQDWLNGKEYKCKVSNKALGAPIEKTISK AKGQPREPQVCTLPPSRDELTKNQVSLSCAVKGFYPSDIA VEWESNGQPENNYKTTPPVLDSDGSFFLVSKLTVDKSRW QQGNVFSCSVMHEALHNRFTQKSLSLSPGK |

TABLE 57

Amino acid sequences of human and murine 4-1BB domains used to prepare the hybrid constructs

| | Domains fused (SEQ ID NO:) | Amino acid sequence |
|---|---|---|
| Construct 1 | Murine 4-1BB D1 (N-terminus) (282) | VQNSCDNCQPGTFCRKYNPVCKSCPPSTFSSIGGQPN CNICRVCAGYFRFKKFCSSTHNAECECIEGFHCLGPQ CTRCEKDCRPGQELTKQGCK |
| | Human 4-1BB D2 (C-terminus) (283) | DCCFGTFNDQKRGICRPWTNCSLDGKSVLVNGTKER DVVCGPSPADLSPGASSVTPPAPAREPGHSPQ |
| Construct 2 | Human 4-1BB D1 (N-terminus) (284) | LQDPCSNCPAGTFCDNNRNQICSPCPPNSFSSAGGQR TCDICRQCKGVFRTRKECSSTSNAECDCTPGFHCLGA GCSMCEQDCKQGQELTKKGCK |
| | Murine 4-1BB D2 (C-terminus) (285) | TCSLGTFNDQNGTGVCRPWTNCSLDGRSVLKTGTTE KDVVCGPPVVSFSPSTTISVTPEGGPGGHSLQVL |
| Construct 3 | Human 4-1BB D1 (N-terminus) (284) | LQDPCSNCPAGTFCDNNRNQICSPCPPNSFSSAGGQR TCDICRQCKGVFRTRKECSSTSNAECDCTPGFHCLGA GCSMCEQDCKQGQELTKKGCK |

The SPR experiments were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany). Anti-human Fab antibody (Biacore, Freiburg/Germany) was directly coupled on a CM5 chip at pH 5.0 using the standard amine coupling kit (Biacore, Freiburg/Germany). The immobilization level was approximately 8,000 RU. Phage-display derived anti-4-1BB antibodies were captured for 60 seconds at 100 nM. Recombinant hybrid human/mouse 4-1BB Fc(kih) variants were passed at 200 nM with a flow of 30 μL/minute through the flow cells over 120 seconds. The dissociation was monitored for 120 seconds (FIGS. 29A-29D).

Human 4-1BB-D1 (construct 3) was directly coupled to CM5 chip at approximately 1000 RU. Anti-4-1BB antibodies at 200 nM were passed at 30 μL/minute for 180 sec and dissociation was monitored for 60 seconds (FIGS. 30A-30D). Bulk refractive index differences were corrected for by subtracting the response obtained on reference flow cell. Here, the antigens were flown over a surface with immobilized anti-human Fab antibody but on which HBS-EP has been injected rather than the antibodies.

The phage-derived clones 12B3, 11D5 and 9B11 bind both human domain 1-containing 4-1BB Fc(kih) molecules. The phage-derived clones 25G7 binds human domain 2-containing hybrid 4-1BB Fc(kih) molecule. The phage-derived clones 20G2 binds murine domain 1-containing hybrid 4-1BB Fc(kih) molecule. A summary can be found in Table 58.

TABLE 58

Binding of hybrid 4-1BB Fc(kih) variants to anti-4-1BB antibodies
1 = binding; 0 = no binding.

| | hybrid 4-1BB Fc(kih) | | | | |
|---|---|---|---|---|---|
| | Construct 1 | | Construct 2 | | Construct 3 |
| Clone | murine 4-1BB D1 (N-) | human 4-1BB D2 (C-) | human 4-1BB D1 (N-) | murine 4-1BB D2 (C-) | human 4-1BB D1 (N-) |
| 12B3 | 0 | | 1 | | 1 |
| 25G7 | 1 | | 0 | | 0 |
| 11D5 | 0 | | 1 | | 1 |
| 9B11 | 0 | | 1 | | 1 |
| 20G2 | 1 | | 0 | | 0 |

Example 8

Functional Properties of Anti 4-1BB Binding Clones 8.1 Functional Properties of Anti-human 4-1BB Binding Clones 4-1BB serves as a co-stimulatory receptor and improves expansion, cytokine production and functional properties of T cells in a TCR-dependent manner. TCR-activation via surface immobilized anti-CD3 antibody or peptide-pulsed antigen presenting cells induces up-regulation of 4-1BB on T cells (Pollok et al. (1993) J. Immunol. 150(3): 771-781) and support after engagement the immune response by boosting expansion and cytokine release (Hurtado et al. (1995) J Immunology 155(7), 3360-3367). To test boosting capacity of the generated anti-human 4-1BB antibodies, round-bottom suspension 96-well plates (Greiner bio-one, cellstar, Cat.-No. 650185) were coated over night with DPBS containing 2 µg/mL AffiniPure F(ab')2 fragment goat anti-human IgG, Fcγ-fragment-specific (Jackson Immunoresearch, Cat.-No. 109-006-008) and 2 µg/mL AffiniPure goat anti-mouse IgG, Fcγ-fragment-specific (Jackson Immunoresearch, Cat.-No 115-005-008). Plates were washed with DPBS to remove excessive molecules and were blocked for 90 min at 37° C. with DPBS containing 1% (w/v) BSA (SIGMA-Aldrich, Cat-No. A3059-100G). Supernatant was removed and plates were incubated with DPBS supplied with 1% (w/v) BSA and with or without 10 ng/mL anti-human CD3 antibody (BioLegend, Cat.-No. 317315, clone OKT3) for 90 min at 37° C. Plates were washed with DPBS and incubated with DPBS supplied with 1% (w/v) BSA and different concentrations of titrated anti-human 4-1BB IgG1 P329 G LALA antibodies. Plates were washed with DPBS and supernatant was aspirated.

Human PBMCs were isolated as described before (7.1.2) and activated in RPMI 1640 containing 10% (v/v) FBS, 1% (v/v) GlutaMAX-I, 2 ug/mL PHA-L and 200 U/mL Proleukin for 5 days. Cells were further cultured in RPMI 1640 containing 10% (v/v) FBS, 1% (v/v) GlutaMAX-I and 200 U/mL Proleukin for further 21 days at a density of 1-2×10$^6$ cells/mL. Long time cultured PBMCs were harvested washed and CD8 T cells were isolated according to manufactures protocol using human CD8$^+$ T cell isolation kit (Miltenyi Biotec, Cat.-No. 130-096-495). Preactivated and sorted CD8$^+$ T cells were seeded to 7×10$^4$ cells/well in 200 µL/well T cell medium consisting of RPMI 1640 medium supplied with 10% FBS, 1% (v/v) GlutaMAX-I, 1 mM Sodium Pyruvate, 1% (v/v) MEM non-essential amino acids and 50 µM β-Mercaptoethanol. Cells were incubated for 72 h, the last 4 h in the presence of Golgi-Stop (BD Bioscience, Cat.-No. 554724). Cells were washed with DPBS and incubated for 30 min at 4° C. in 100 µL/well DPBS containing 1:5000 diluted LIVE/DEAD Fixable Green Dead Cell Stain (Molecular Probes, Life Technologies, Cat.-No. L-23101). Afterwards cells were washed and incubated for 30 min at 4° C. in 50 µL/well FACS buffer containing 0.5 µg/mL PerCP/Cy5.5-conjugated anti-human CD8 (mouse IgG1 κ, clone RPA-T8, BioLegend, Cat.-No. 301032), 0.5 µg/mL PE/Cy7-conjugated anti-human CD25 (mouse IgG1 κ, clone BC96, BioLegend, Cat.-No. 302612) and 1 µg/mL APC/Cy7-conjugated anti-human PD-1 (mouse IgG1 κ, clone EH12.2H7, BioLegend, Cat.-No. 329922). Cells were washed with FACS buffer and resuspended in 50 µL/well in freshly prepared fixation/permeabilization solution (eBioscience, Cat.-No. 00-5523-00). After incubation for 30 min at 4° C., cells were washed with freshly prepared permeabilization buffer (eBioscience, Cat.-No. 00-5523-00) and incubated for 1 h at 4° C. with 50 µL/well Perm-buffer containing 2 µg/mL APC-labeled anti-human-IFNγ (mo IgG1 κ, clone B27, BD Pharmingen, Cat.-No. 554702) and 2 µg/mL PE-conjugated anti-human-TNFα (mo IgG1 κ, clone MAb11, BD Pharmingen, Cat.-No. 554513). Cells were washed and fixed with DPBS containing 1% formaldehyde. Cells were acquired the next day using 2-laser Canto II (BD, DIVA software). Gates were set on CD8$^+$ T cells and frequency of TNFα and IFNγ secreting CD8$^+$ T cells were determined. Using Graph Pad Prism (Graph Pad Software Inc.) data was blotted and curves were calculated using non-linear regression curve fit (robust fit).

As described before in the absence of TCR- or CD3-stimulation 4-1BB engagement has no effect on CD8$^+$ T cell function (Pollok 1995), whereas in the presence of suboptimal CD3-activation co-stimulation of 4-1BB increase cytokine secretion (FIG. 31A or 31C). Sub-optimal activation via CD3-antibody induces IFNγ-secretion in 30% of CD8$^+$ T cells in the total CD8$^+$ T cell population. Addition of 4-1BB-co-stimulation increases the IFNγ+ CD8 T cell population up to 55% in a concentration dependent manner (FIG. 31B). Table 59 shows the corresponding EC$_{50}$ values. TNFα secretion could be increased from 23% to 39% of total CD8+ T cell population (FIG. 31D). Similar to their binding properties clones 12B3 and 11D5 increase INFγ expression superior to 25G7 and 9B11 in frequency and EC50. Therefore our generated clones are functional and can improve TCR-mediated T cell activation and function. If the anti-4-1BB-specific antibodies were not surface immobilized, they did not improve CD8$^+$ T cell activation (not shown).

TABLE 59

| EC$_{50}$ values of increase of IFNγ secretion in activated CD8$^+$ T Cells | |
|---|---|
| Clone | EC$_{50}$ CD8 [nM] |
| 25G7 | 0.12 |
| 12B3 | 0.07 |
| 11D5 | 0.06 |
| 9B11 | 0.12 |

8.2 Functional Properties of Anti-mouse 4-1BB Binding Clone 20G2 In Vitro

To prevent crosslinking of agonistic anti-4-1BB antibodies via Fc-receptors, mutation were introduced in the Fc-part of the antibodies. Similar to the P329G LALA mutation in human IgG1 antibodies a DAPG mutation was introduced into the Fc-part of mouse IgG1 molecules. To test if this prevents the FcR-crosslinking and therefore activation capacity, mouse splenocytes were activated with a sub-optimal concentration of anti-mouse CD3 antibody and different concentration of clone 20G2 as mouse IgG1 and mouse IgG1 DAPG.

Spleens were obtained from healthy female C57BL/6 mice (age 7-9 weeks, Charles River, France) and homogenized in 3 mL MACS buffer using C tubes (Miltenyi Biotec, Cat.-No. 130-096-334) and a gentle MACS Octo Dissociator (Miltenyi Biotec, Cat.-No. 130-095-937). After centrifugation (400×g, 8 min, RT) cell pellet was resuspended in 7 ml ACK lysis buffer and erythrolysis was performed for 10 min at 37° C. Erythrolysis was stopped by addition of T cell medium consisting of RPMI 1640 medium supplied with 10% FBS, 1% (v/v) GlutaMAX-I, 1 mM Sodium Pyruvate, 1% (v/v) MEM non-essential amino acids and 50 µM β-Mercaptoethanol. Splenocytes were washed with DPBS and filtered through a 70 µm cell strainer (Corning Cat.-No. 431751). Splenocytes were resuspended to 2×10$^7$ cells/mL in 37° C. DPBS and Cell Proliferation Dye eFluor 670 (eBioscience, Cat.-No. 65-0840-90) were added to a final concentration of 2.5 mM. Cells were incubated for 10 min at 37° C., labeling process was stopped by adding FBS and cells were washed. 200 µL/well T cell medium containing 0.5 µg/mL anti-mouse CD3-specific hamster IgG (clone 145-2C11, BD Pharmingen, Cat.-No. 553057), 0.01-50 nM titrated anti-mouse 4-1BB-specific clone 20G2 mouse IgG1 or mouse IgG1 DAPG or isotype control MOPC-21 mouse IgG1 (BD Bioscience, Cat.-No. 554121) or isotype control DP47 moIgG1 DAPG and 1×10$^5$ splenocytes were transferred to wells of a 96-well round-bottom tissue culture plate (TPP, Cat.-No. 92097). Plates were incubated for 48 h. Cells were washed, resuspended in 25 µL/well FACS buffer containing 1 µg/mL BV711-conjugated anti-mouse-CD8 rat IgG2a (clone 53-6.7, BioLegend, Cat.-No. 100748) and 2 µg/mL BV421-conjugated anti-mouse CD4 Rat IgG2a (clone RM4-5, BioLegend, Cat.-No. 100544) and incubated for 20 min at 4° C. Cells were washed and resuspended in 100 µL/well freshly prepared fixation/permeabilization solution (eBioscience, Cat.-No. 00-5523-00). After incubation for 30 min at 4° C. cells were washed with DPBS and resuspended in 100 µL/well freshly prepared permeabilization buffer (eBioscience, Cat.-No. 00-5523-00) containing 10 µg/mL Alexa Fluor 488-conjugated anti-mouse Eomes rat IgG2a (clone DAN11MAG, eBioscience, Cat.-No. 53-4875-82) and 2 µg/mL PE-conjugated anti-mouse Granzyme B rat IgG2a (clone NGZB, eBioscience, Cat.-No. 12-8898-82). Cells were incubated for 1 h at RT in the dark, washed with permeabilization buffer, resuspended in FACS buffer and acquired using the 5-laser Fortessa (BD Bioscience, DIVA software). Gates were set on CD8$^+$ T cells and frequency of Eomes and Granzyme B expressing CD8$^+$ T cells were determined. Using Graph Pad Prism (Graph Pad Software Inc.) data was blotted and curves were calculated using non-linear regression curve fit (robust fit).

Figure 32A:
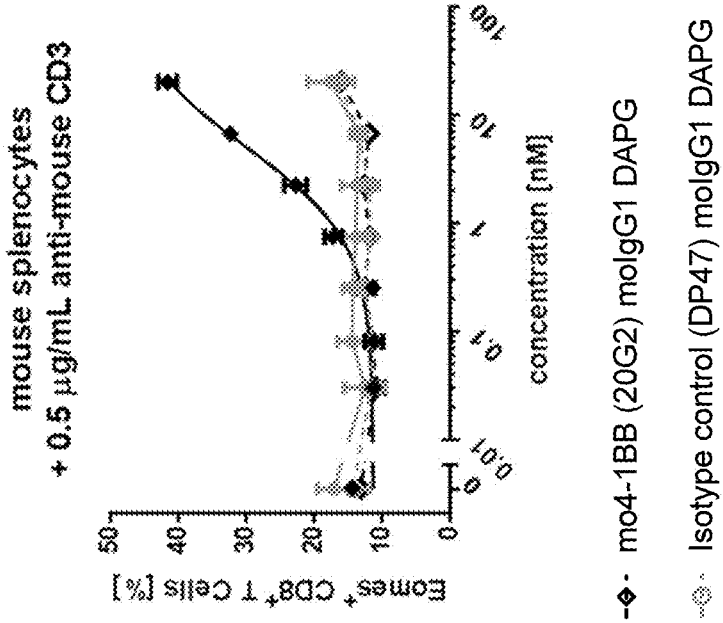
FIGS. 32A and 32B show functional properties of anti-mouse 4-1BB clone 20G2 in vitro. Mouse splenocytes were incubated in the presence of 0.5 ug/mL anti-mouse IgG1 CD3 hamster IgG (clone 145-2C11) and different concentration of anti-mouse 4-1BB antibodies (filled black diamond: mouse IgG, open black diamond: mouse IgG DAPG) or fitting isotype controls (filled grey circle: mouse IgG1, open grey circle: mouse IgG1 DAPG) in solution. The concentration is indicated on the x-axis in nM. Only if the anti-mouse 4-1BB clone 20G2 mouse IgG1 (black diamonds) could be cross-linked via FcR-expressing cells, activation of Granzyme B (FIG. 32A) and Eomesodermin (FIG. 32B) could be increased in a concentration dependent manner.
Figure 32B:
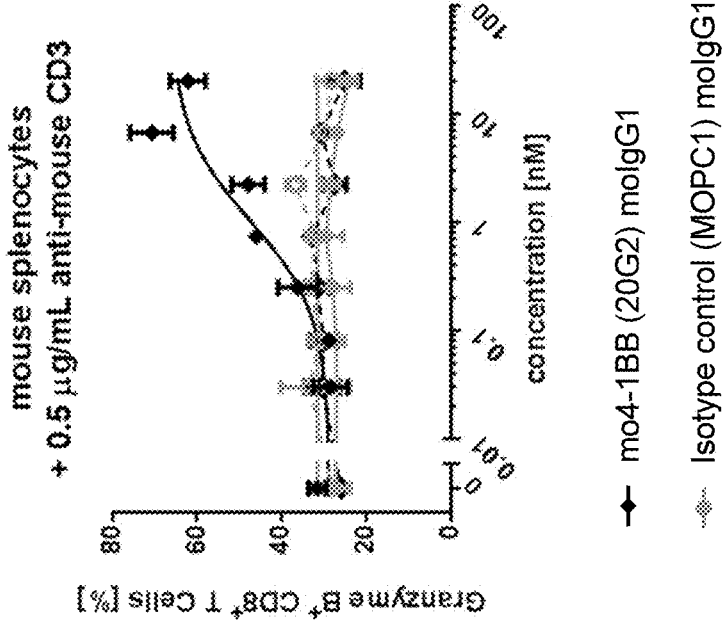

An optimal activation of CD8$^+$ T cells induces Eomesodermin (Eomes) expression, a T-box transcription factor regulating the cytolytic effector mechanisms of CD8$^+$ T cells (Glimcher et al. 2004) and cytolytic enzymes like granzyme B. As shown in FIGS. 32A and 32B, the used 0.5 µg/mL anti-mouse CD3 antibody concentration was sub-optimal and the frequency of granzyme B expressing CD8$^+$ T cells did not exceed above 30% and of eomesodermin (eomes) expressing CD8$^+$ T cells did not exceed above 18%. Only if a sufficient amount of anti-mouse 4-1BB clone 20G2 mouse IgG1 was added more CD8$^+$ T cells started to express granzyme B (FIG. 32A) and eomesodermin (FIG. 32B). This proofs, that clone 20G2 is an agonistic binder and is able to activated T cells by engaging mouse 4-1BB. If crosslinking of clone 20G2 was impaired due to the DAPG mutation, no effect of improved activation was seen, which shows, that also with mouse cells crosslinking of the anti-4-1BB antibody is needed to induce 4-1BB down-stream signaling. Therefore the DAPG mutation prevents a sufficient crosslinking and presentation of the antibody via Fc-binding receptor. Non-mouse-4-1BB-specific isotype controls had no effect on T cell activation.

8.3 Functional Properties of Anti-mouse 4-1BB Binding Clone 20G2 In Vivo

Treatment of mice with agonistic anti-mouse 4-1BB rat IgG2a leads to an accumulation of activated T cells in the liver in tumor-free (Dubrot et al. (2010) Cancer Immunol Immunother. 59(8), 1223-33; Niu et al. (2007) J Immunol. 178(7):4194-213) and tumor-bearing mice (Wang et al. (2010) J Immunol. 185(12):7654-62; Kocak et al. (2006) Cancer Res. 66(14):7276-84) and induce a hepatic inflammation. Similar a clinical Phase II trial with anti-4-1BB antibody Urelumab (huIgG4) in stage IV melanoma patients had to be terminated due to unusually high incidence of grade 4 hepatitis (Ascierto P. et al. (2010) Semin Oncol. 37(5), 508-16). To test, if anti-mouse 4-1BB mouse IgG1 can induce a similar T cell accumulation into the liver as reported agonistic anti-mouse 4-1BB rat IgG2a antibodies and further, if the DAPG mutation can prevent this, naïve healthy female C57BL/6 mice (age 7-9 weeks, Charles River, France) were treated with anti-mouse 4-1BB IgG1 and IgG DAPG clone 20G2. Mice were kept and house as described herein before. 150 µg antibody were injected intravenously into the tail vain weekly for 3 weeks. Mice were sacrificed by cervical dislocation one day after second injection and one day and eight days after third injection. Spleens and liver were dissected and stored on ice in RPMI 1640 supplemented with 10% (v/v) heat-inactivated FBS and 1% (v/v) GlutaMAX-I. Splenocytes were isolated as described before (8.2). Leucocytes from the liver were isolated as following: each liver was transferred to C tube (Miltenyi Biotec, Cat.-No. 130-096-334) containing 5 mL RPMI 1640 supplied with 0.3 mg/mL Dispase II (Roche Applied Science, Cat.-No.: 04942078001), 1 µg/mL Dnase I (Roche Applied Science, Cat.-No.: 11284932001) and 2 mg/mL Collagenase D (Roche Applied Science, Cat.-No.: 11 088 882001), tissue was disrupted using gentle MACS Octo Dissociator using the program "m_liver_01" (Miltenyi Biotec, Cat.-No. 130-095-937) and livers were incubated for 30 min at 37° C. The digested livers were disrupted a second time using the MACS Octo Dissociator using the program "m_liver_02". After centrifugation (400×g, 8 min, RT) cell pellet was resuspended in 7 ml ACK lysis buffer and erythrolysis was performed for 10 min at 37° C. Erythrolysis was stopped by addition of RPMI 1640 medium supplied with 10% FBS and 1% (v/v) GlutaMAX-I. 10$^6$ cells/well splenocytes or leucocytes from the liver were transferred to a round-bottom 96-well suspension cell plate (Greiner bio-one, cellstar, Cat.-No. 650185) and washed once with DPBS. Cells were resuspended in 100 µL/well containing 1:5000 diluted LIVE/DEAD Fixable Green Dead Cell Stain Kit (Live Technologies Cat.-No. L-23101) and incubated for 30 min at 4° C. Afterwards cells were washed and resuspended in 50 µL/well in FACS-buffer containing 6 µg/mL PE-conjugated anti-mouse CD137 syrian hamster IgG (clone 17B5, BioLegend, Cat.-No. 106106) or Syrian hamster isotype control (clone SHG-1, BioLegend, Cat.-No. 402008), 2 µg/mL PerCP/Cy5.5-conjugated anti-mouse TCR-β Armenian hamster IgG (clone H57-597, BioLegend, Cat.-No. 109228), 5 µg/mL PE/Cy7-conjugated anti-mouse CD25 rat IgG1 (clone PC61, BD Bioscience, Cat.-No. 552880) or rat IgG1 γ isotype control (clone A110-1, BD Bioscience, Cat.-No. 552869), 2 µg/mL Alexa Fluor 700-labeled anti-mouse CD8a ratIgG2a κ (clone 53-6.7, BD Bioscience, Cat.-No. 557959), 0.25 µg/mL BV421-conjugated anti-mouse CD4 rat igG2b κ (clone GK1.5, BioLegend, Cat.-No. 100438), 4 µg/mL BV605-conjugated anti-mouse-CD11c Armenian hamster IgG (clone N418, BioLegend, Cat.-No. 117333) or Armenian hamster isotype control (clone HTK888, BioLegend, Cat.-No. 400943) and incubated for 30 min at 4° C. Cells were washed and resuspended in 100 µL/well freshly prepared fixation/permeabilization solution (eBioscience, Cat.-No. 00-5523-00). After incubation for 30 min at 4° C. cells were washed with freshly prepared permeabilization buffer (eBioscience, Cat.-No. 00-5523-00) and resuspended in 50 µL/well permeabilization buffer containing 0.2 µg/mL eF660-conjugated anti-mouse Ki67 rat IgG2a κ (clone SolA15, eBioscience, Cat.-No. 50-5698-82). Cells were incubated for 30 min at 4° C., washed twice with permeabilization buffer and fixed with 50 µL/well DPBS containing 1% formaldehyde. The next day cells were acquired using the 5-laser Fortessa (BD Bioscience, DIVA software). Data was analyzed using FlowJo (FlowJo, LLC), gates were set on CD8$^+$ or CD4$^+$ T cells and frequency of CD137$^+$, CD25$^+$, CD11c$^+$ and Ki67$^+$ T cells were determined. Using Graph Pad Prism (Graph Pad Software Inc.) data was blotted.

Figure 33:
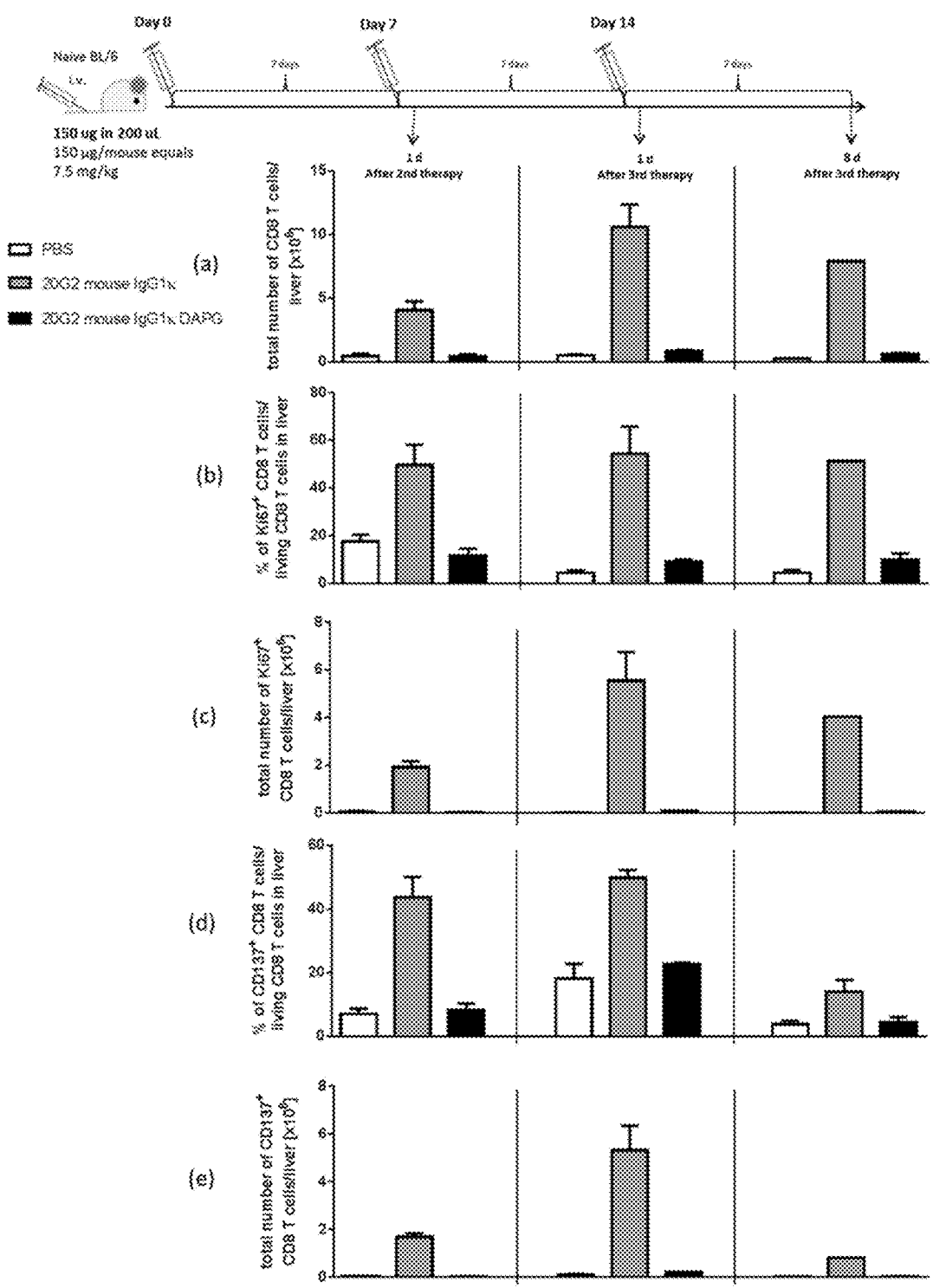
FIG. 33 shows functional properties of anti-mouse 4-1BB clone 20G2 in vivo. Shown are the results of three mice per group. After treatment with anti-mouse 4-1BB clone 20G2 mouse IgG1 (grey bars) CD8+ T cells are accumulating in the liver in total number (a). Further proliferation marker Ki67 was upregulated in frequency (b) and total number (c) on CD8+ T cells. It also induced a positive feedback loop by upregulation of 4-1BB (CD137) in frequency (d) and total number (e) on CD8+ T cells. The strongest effect was seen 1 day after third injection. If mice were treated with anti-mouse 4-1BB clone 20G2 mouse IgG1 DAPG (black bars) crosslinking of antibody was prevented and no 4-1BB activation occurred. Therefore CD8+ T cells in the liver were similar in number and phenotype as in the PBS treated mice (white bars).

As shown in FIG. 33, only treatment of mice with anti-mouse 4-1BB clone 20G2 mouse IgG1 induce the accumulation, proliferation and increased 4-1BB (CD137) expression on CD8+ T cells in the liver, whereas preventing crosslinking via FcR-binding with the DAPG mutation bypasses activation of CD8+ T cells. Preventing FcR-crosslinking with the DAPG mutation prevents the activation of CD8+ T cells in the liver (FIG. 33), although both molecules show similar binding properties to mouse CD137 expressed on T cells (FIGS. 25B and 25D) and therefore feature the same potential activation properties.

Example 9

Preparation, Purification and Characterization of Bispecific Bivalent Antibodies Targeting 4-1BB and a Tumor Associated Antigen (TAA)

9.1 Generation of Bispecific Bivalent Antibodies Targeting 4-1BB and Fibroblast Activation Protein (FAP) (2+2 Format)

Bispecific agonistic 4-1BB antibodies with bivalent binding for 4-1BB and for FAP were prepared. The crossmab technology was applied to reduce the formation of wrongly paired light chains as described in International patent application No. WO 2010/145792 A1.

The generation and preparation of the FAP binders is described in WO 2012/020006 A2, which is incorporated herein by reference.

Figure 34A:
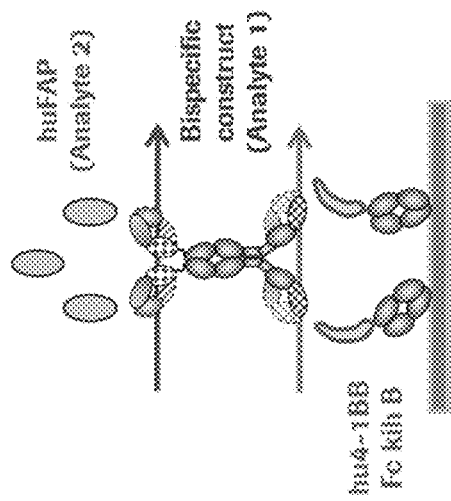
FIG. 34A shows a schematic scheme of an exemplary bispecific, bivalent antigen binding molecule of the invention comprising two Fab fragments binding to 4-1BB and two cross-Fab fragments binding to FAP (2+2 format).

In this example, a crossed Fab unit (VHCL) of the FAP binder 28H1 was C-terminally fused to the heavy chain of an anti-4-1BB hu IgG1 using a (G4S)$_4$ connector sequence. This heavy chain fusion was co-expressed with the light chain of the anti-4-1BB and the corresponding FAP crossed light chain (VLCH1). The Pro329Gly, Leu234Ala and Leu235Ala mutations have been introduced in the constant region of the heavy chains to abrogate binding to Fc gamma receptors according to the method described in International Patent Appl. Publ. No. WO 2012/130831 A1. The resulting bispecific, bivalent construct is analogous to the one depicted in FIG. 34A.

Table 60 shows, respectively, the nucleotide and amino acid sequences of mature bispecific, bivalent anti-4-1BB/anti-FAP human IgG1 P329GLALA antibodies.

TABLE 60

Sequences of bispecific, bivalent anti-4-1BB/anti-FAP human IgG1 P329GLALA antigen binding molecules

| SEQ ID NO: | Description | Sequence |
|---|---|---|
| 286 | (12B3) VHCH1-Heavy chain-(28H1) VHCL (nucleotide sequence) | CAGGTGCAATTGGTGCAGTCTGGGGCTGAGGTGAAGAAG CCTGGGTCCTCGGTGAAGGTCTCCTGCAAGGCCTCCGGAG GCACATTCAGCAGCTACGCTATAAGCTGGGTGCGACAGG CCCCTGGACAAGGGCTCGAGTGGATGGGAGGGATCATCC CTATCTTTGGTACAGCAAACTACGCACAGAAGTTCCAGGG CAGGGTCACCATTACTGCAGACAAATCCACGAGCACAGC CTACATGGAGCTGAGCAGCCTGAGATCTGAGGACACCGC CGTGTATTACTGTGCGAGATCTGAATTCCGTTTCTACGCT GACTTCGACTACTGGGGCCAAGGGACCACCGTGACCGTC TCCTCAGCTAGCACCAAGGGCCCATCCGTGTTCCCTCTGG CCCCTTCCAGCAAGTCTACCTCTGGCGGCACAGCCGCTCT GGGCTGCCTCGTGAAGGACTACTTCCCCGAGCCTGTGACA GTGTCCTGGAACTCTGGCGCCCTGACATCCGGCGTGCACA CCTTTCCAGCTGTGCTGCAGTCCTCCGGCCTGTACTCCCTG TCCTCCGTCGTGACAGTGCCCTCCAGCTCTCTGGGCACCC AGACCTACATCTGCAACGTGAACCACAAGCCCTCCAACA CCAAGGTGGACAAGAAGGTGGAACCCAAGTCCTGCGACA AGACCCACACCTGTCCCCCTTGTCCTGCCCCTGAAGCTGC TGGCCGGCCCTAGCGTGTTCCTGTTCCCCCCAAAGCCCAAG GACACCCTGATGATCTCCCGGACCCCCGAAGTGACCTGCG TGGTGGTGGATGTGTCCCACGAGGACCCTGAAGTGAAGT TCAATTGGTACGTGGACGGCGTGGAAGTGCACAATGCCA AGACCAAGCCTAGAGAGGAACAGTACAACTCCACCTACC GGGTGGTGTCCGTGCTGACCGTGCTGCACCAGGATTGGCT GAACGGCAAAGAGTACAAGTGCAAGGTGTCCAACAAGGC CCTGGGAGCCCCCATCGAAAAGACCATCTCCAAGGCCAA GGGCCAGCCTCGCGAGCCTCAGGTGTACACCCTGCCCCCT AGCAGAGATGAGCTGACCAAGAACCAGGTGTCCCTGACC TGTCTCGTGAAAGGCTTCTACCCCTCCGATATCGCCGTGG AATGGGAGAGCAACGGCCAGCCCGAGAACAACTACAAG ACCACCCCCCCTGTGCTGGACTCCGACGGCTCATTCTTCC TGTACTCTAAGCTGACAGTGGACAAGTCCCGGTGGCAGC AGGGCAACGTGTTCTCCTGCTCCGTGATGCACGAGGCCCT GCACAACCACTACACCCAGAAGTCCCTGTCCCTGTCTCCC GGGGGAGGCGGAGGATCTGGCGGAGGCGGATCCGGTGGT GGCGGATCTGGGGGCGGTGGATCTGAGGTGCAGCTGCTG GAATCTGGGGGAGGACTGGTGCAGCCAGGCGGATCTCTG AGGCTGTCCTGCGCTGCTTCCGGCTTTACCTTCTCCAGCC ACGCCATGAGTTGGGTGCGCCAGGCACCCGGAAAAGGAC TGGAATGGGTGTCAGCCATCTGGGCCTCCGGCGAGCAGT ACTACGCCGATAGCGTGAAGGGCCGGTTCACCATCTCTCG GGATAACAGCAAGAATACTCTGTACCTGCAGATGAACTC CCTGCGCGCTGAAGATACCGCTGTGTATTACTGCGCCAAG |

TABLE 60-continued

Sequences of bispecific, bivalent anti-4-1BB/anti-FAP human IgG1 P329GLALA antigen binding molecules

| SEQ ID NO: | Description | Sequence |
|---|---|---|
|  |  | GGCTGGCTGGGCAACTTCGATTACTGGGGCCAGGGAACC CTCGTGACTGTCTCGAGCGCTTCTGTGGCCGCTCCCTCCG TGTTCATCTTCCCACCTTCCGACGAGCAGCTGAAGTCCGG CACTGCCTCTGTCGTGTGCCTGCTGAACAACTTCTACCCT CGGGAAGCCAAGGTGCAGTGGAAAGTGGATAACGCCCTG CAGTCCGGCAACTCCCAGGAATCCGTGACCGAGCAGGAC TCCAAGGACAGCACCTACTCCCTGAGCAGCACCCTGACCC TGTCCAAGGCCGACTACGAGAAGCACAAGGTGTACGCCT GTGAAGTGACCCACCAGGGCCTGTCCAGCCCCGTGACCA AGTCCTTCAACCGGGGCGAGTGC |
| 259 | VLCL-Light chain 1 (12B3) (nucleotide sequence) | see Table 40 |
| 215 | VLCH1-Light chain 2 (28H1) (nucleotide sequence) | GAGATCGTGCTGACCCAGTCTCCCGGCACCCTGAGCCTGA GCCCTGGCGAGAGAGCCACCCTGAGCTGCAGAGCCAGCC AGAGCGTGAGCCGGAGCTACCTGGCCTGGTATCAGCAGA AGCCCGGCCAGGCCCCCAGACTGCTGATCATCGGCGCCA GCACCCGGGCCACCGGCATCCCCGATAGATTCAGCGGCA GCGGCTCCGGCACCGACTTCACCCTGACCATCAGCCGGCT GGAACCCGAGGACTTCGCCGTGTACTACTGCCAGCAGGG CCAGGTGATCCCCCCCACCTTCGGCCAGGGCACCAAGGT GGAAATCAAGAGCTCCGCTAGCACCAAGGGCCCCTCCGT GTTTCCTCTGGCCCCAGCAGCAAGAGCACCTCTGGCGGA ACAGCCGCCCTGGGCTGCCTGGTGAAAGACTACTTCCCCG AGCCCGTGACCGTGTCCTGGAACTCTGGCGCCCTGACCAG CGGCGTGCACACCTTTCCAGCCGTGCTGCAGAGCAGCGG CCTGTACTCCCTGAGCAGCGTGGTGACAGTGCCCTCCAGC AGCCTGGGCACCCAGACCTACATCTGCAACGTGAACCAC AAGCCCAGCAACACCAAAGTGGACAAGAAGGTGGAACCC AAGAGCTGCGAC |
| 287 | (12B3) VHCH1-Heavy chain-(28H1) VHCL | QVQLVQSGAEVKKPGSSVKVSCKASGGTFSSYAISWVRQAP GQGLEWMGGIIPIFGTANYAQKFQGRVTITADKSTSTAYME LSSLRSEDTAVYYCARSEFRFYADFDYWGQGTTVTVSSAST KGPSVFPLAPSSKSTSGGTAALGCLVKDYFPEPVTVSWNSG ALTSGVHTFPAVLQSSGLYSLSSVVTVPSSSLGTQTYICNVN HKPSNTKVDKKVEPKSCDKTHTCPPCPAPEAAGGPSVFLFPP KPKDTLMISRTPEVTCVVVDVSHEDPEVKFNWYVDGVEVH NAKTKPREEQYNSTYRVVSVLTVLHQDWLNGKEYKCKVSN KALGAPIEKTISKAKGQPREPQVYTLPPSRDELTKNQVSLTC LVKGFYPSDIAVEWESNGQPENNYKTTPPVLDSDGSFFLYSK LTVDKSRWQQGNVFSCSVMHEALHNHYTQKSLSLSPGGGG GSGGGGSGGGGSGGGGSEVQLLESGGGLVQPGGSLRLSCA ASGFTFSSHAMSWVRQAPGKGLEWVSAIWASGEQYYADSV KGRFTISRDNSKNTLYLQMNSLRAEDTAVYYCAKGWLGNF DYWGQGTLVTVSSASVAAPSVFIFPPSDEQLKSGTASVVCLL NNFYPREAKVQWKVDNALQSGNSQESVTEQDSKDSTYSLSS TLTLSKADYEKHKVYACEVTHQGLSSPVTKSFNRGEC |
| 261 | VLCL-Light chain 1 (12B3) | see Table 40 |
| 217 | VLCH1-Light chain 2 (28H1) | EIVLTQSPGTLSLSPGERATLSCRASQSVSRSYLAWYQQKPG QAPRLLIIGASTRATGIPDRFSGSGSGTDFTLTISRLEPEDFAV YYCQQGQVIPPTFGQGTKVEIKSSASTKGPSVFPLAPSSKSTS GGTAALGCLVKDYFPEPVTVSWNSGALTSGVHTFPAVLQSS GLYSLSSVVTVPSSSLGTQTYICNVNHKPSNTKVDKKVEPKS CD |
| 288 | (25G7) VHCH1-Heavy chain-(28H1) VHCL (nucleotide sequence) | GAGGTGCAATTGTTGGAGTCTGGGGGAGGCTTGGTACAG CCTGGGGGGTCCCTGAGACTCTCCTGTGCAGCCTCCGGAT TCACCTTTAGCAGTTATGCCATGAGCTGGGTCCGCCAGGC TCCAGGGAAGGGGCTGGAGTGGGTCTCAGCTATTAGTGG TAGTGGTGGTAGCACATACTACGCAGACTCCGTGAAGGG CCGGTTCACCATCTCCAGAGACAATTCCAAGAACACGCTG TATCTGCAGATGAACAGCCTGAGAGCCGAGGACACGGCC GTATATTACTGTGCGCGTGACGACCCGTGGCCGCCGTTCG ACTACTGGGGCCAAGGAACCCTGGTCACCGTCTCGAGTG CTAGCACCAAGGGCCCATCCGTGTTCCCTCTGGCCCCTTC CAGCAAGTCTACCTCTGGCGGCACAGCCGCTCTGGGCTGC CTCGTGAAGGACTACTTCCCCGAGCCTGTGACAGTGTCCT |

TABLE 60-continued

Sequences of bispecific, bivalent anti-4-1BB/anti-FAP human IgG1 P329GLALA antigen binding molecules

| SEQ ID NO: | Description | Sequence |
|---|---|---|
| | | GGAACTCTGGCGCCCTGACATCCGGCGTGCACACCTTTCC<br>AGCTGTGCTGCAGTCCTCCGGCCTGTACTCCCTGTCCTCC<br>GTCGTGACAGTGCCCTCCAGCTCTCTGGGCACCCAGACCT<br>ACATCTGCAACGTGAACCACAAGCCCTCCAACACCAAGG<br>TGGACAAGAAGGTGGAACCCAAGTCCTGCGACAAGACCC<br>ACACCTGTCCCCCTTGTCCTGCCCCTGAAGCTGCTGGCGG<br>CCCTAGCGTGTTCCTGTTCCCCCCAAAGCCCAAGGACACC<br>CTGATGATCTCCCGGACCCCCGAAGTGACCTGCGTGGTGG<br>TGGATGTGTCCCACGAGGACCCTGAAGTGAAGTTCAATTG<br>GTACGTGGACGGCGTGGAAGTGCACAATGCCAAGACCAA<br>GCCTAGAGAGGAACAGTACAACTCCACCTACCGGGTGGT<br>GTCCGTGCTGACCGTGCTGCACCAGGATTGGCTGAACGGC<br>AAAGAGTACAAGTGCAAGGTGTCCAACAAGGCCCTGGGA<br>GCCCCCATCGAAAAGACCATCTCCAAGGCCAAGGGCCAG<br>CCTCGCGAGCCTCAGGTGTACACCCTGCCCCCTAGCAGAG<br>ATGAGCTGACCAAGAACCAGGTGTCCCTGACCTGTCTCGT<br>GAAAGGCTTCTACCCCTCCGATATCGCCGTGGAATGGGA<br>GAGCAACGGCCAGCCCGAGAACAACTACAAGACCACCCC<br>CCCTGTGCTGGACTCCGACGGCTCATTCTTCCTGTACTCTA<br>AGCTGACAGTGGACAAGTCCCGGTGGCAGCAGGGCAACG<br>TGTTCTCCTGCTCCGTGATGCACGAGGCCCTGCACAACCA<br>CTACACCCAGAAGTCCCTGTCCCTGTCTCCGGGGGAGGC<br>GGAGGATCTGGCGGAGGCGGATCCGGTGGTGGCGGATCT<br>GGGGGCGGTGGATCTGAGGTGCAGCTGCTGGAATCTGGG<br>GGAGGACTGGTGCAGCCAGGCGGATCTCTGAGGCTGTCC<br>TGCGCTGCTTCCGGCTTTACCTTCTCCAGCCACGCCATGA<br>GTTGGGTGCGCCAGGCACCCGGAAAAGGACTGGAATGGG<br>TGTCAGCCATCTGGGCCTCCGGCGAGCAGTACTACGCCGA<br>TAGCGTGAAGGGCCGGTTCACCATCTCTCGGGATAACAG<br>CAAGAATACTCTGTACCTGCAGATGAACTCCCTGCGCGCT<br>GAAGATACCGCTGTGTATTACTGCGCCAAGGGCTGGCTG<br>GGCAACTTCGATTACTGGGGCCAGGGAACCCTCGTGACT<br>GTCTCGAGCGCTTCTGTGGCCGCTCCCTCCGTGTTCATCTT<br>CCCACCTTCCGACGAGCAGCTGAAGTCCGGCACTGCCTCT<br>GTCGTGTGCCTGCTGAACAACTTCTACCCTCGGGAAGCCA<br>AGGTGCAGTGGAAAGTGGATAACGCCCTGCAGTCCGGCA<br>ACTCCCAGGAATCCGTGACCGAGCAGGACTCCAAGGACA<br>GCACCTACTCCCTGAGCAGCACCCTGACCCTGTCCAAGGC<br>CGACTACGAGAAGCACAAGGTGTACGCCTGTGAAGTGAC<br>CCACCAGGGCCTGTCCAGCCCCGTGACCAAGTCCTTCAAC<br>CGGGGCGAGTGC |
| 263 | VLCL-Light chain 1 (25G7) (nucleotide sequence) | see Table 40 |
| 215 | VLCH1-Light chain 2 (28H1) (nucleotide sequence) | see above |
| 289 | (25G7) VHCH1-Heavy chain-(28H1) VHCL | EVQLLESGGGLVQPGGSLRLSCAASGFTFSSYAMSWVRQAP<br>GKGLEWVSAISGSGGSTYYADSVKGRFTISRDNSKNTLYLQ<br>MNSLRAEDTAVYYCARDDPWPPFDYWGQGTLVTVSSASTK<br>GPSVFPLAPSSKSTSGGTAALGCLVKDYFPEPVTVSWNSGAL<br>TSGVHTFPAVLQSSGLYSLSSVVTVPSSSLGTQTYICNVNHK<br>PSNTKVDKKVEPKSCDKTHTCPPCPAPEAAGGPSVFLFPPKP<br>KDTLMISRTPEVTCVVVDVSHEDPEVKFNWYVDGVEVHNA<br>KTKPREEQYNSTYRVVSVLTVLHQDWLNGKEYKCKVSNKA<br>LGAPIEKTISKAKGQPREPQVYTLPPSRDELTKNQVSLTCLV<br>KGFYPSDIAVEWESNGQPENNYKTTPPVLDSDGSFFLYSKLT<br>VDKSRWQQGNVFSCSVMHEALHNHYTQKSLSLSPGGGGGS<br>GGGGSGGGGSGGGGSEVQLLESGGGLVQPGGSLRLSCAAS<br>GFTFSSHAMSWVRQAPGKGLEWVSAIWASGEQYYADSVKG<br>RFTISRDNSKNTLYLQMNSLRAEDTAVYYCAKGWLGNFDY<br>WGQGTLVTVSSASVAAPSVFIFPPSDEQLKSGTASVVCLLNN<br>FYPREAKVQWKVDNALQSGNSQESVTEQDSKDSTYSLSSTL<br>TLSKADYEKHKVYACEVTHQGLSSPVTKSFNRGEC |
| 265 | VLCL-Light chain 1 (25G7) | see Table 40 |

TABLE 60-continued

Sequences of bispecific, bivalent anti-4-1BB/anti-FAP human IgG1 P329GLALA antigen binding molecules

| SEQ ID NO: | Description | Sequence |
|---|---|---|
| 217 | VLCH1-Light chain 2 (28H1) | see above |
| 290 | (11D5) VHCH1-Heavy chain-(28H1) VHCL (nucleotide sequence) | CAGGTGCAATTGGTGCAGTCTGGGGCTGAGGTGAAGAAG CCTGGGTCCTCGGTGAAGGTCTCCTGCAAGGCCTCCGGAG GCACATTCAGCAGCTACGCTATAAGCTGGGTGCGACAGG CCCCTGGACAAGGGGCTGAGTGGATGGGAGGGATCATCC CTATCTTTGGTACAGCAAACTACGCACAGAAGTTCCAGGG CAGGGTCACCATTACTGCAGACAAATCCACGAGCACAGC CTACATGGAGCTGAGCAGCCTGAGATCTGAGGACACCGC CGTGTATTACTGTGCGAGATCTACTCTGATCTACGGTTAC TTCGACTACTGGGGCCAAGGGACCACCGTGACCGTCTCCT CAGCTAGCACCAAGGGCCCATCCGTGTTCCCTCTGGCCCC TTCCAGCAAGTCTACCTCTGGCGGCACAGCCGCTCTGGGC TGCCTCGTGAAGGACTACTTCCCCGAGCCTGTGACAGTGT CCTGGAACTCTGGCGCCCTGACATCCGGCGTGCACACCTT TCCAGCTGTGCTGCAGTCCTCCGGCCTGTACTCCCTGTCCT CCGTCGTGACAGTGCCCTCCAGCTCTCTGGGCACCCAGAC CTACATCTGCAACGTGAACCACAAGCCCTCCAACACCAA GGTGGACAAGAAGGTGGAACCCAAGTCCTGCGACAAGAC CCACACCTGTCCCCCTTGTCCTGCCCCTGAAGCTGCTGGC GGCCCTAGCGTGTTCCTGTTCCCCCCAAAGCCCAAGGACA CCCTGATGATCTCCCGGACCCCCGAAGTGACCTGCGTGGT GGTGGATGTGTCCCACGAGGACCCTGAAGTGAAGTTCAA TTGGTACGTGGACGGCGTGGAAGTGCACAATGCCAAGAC CAAGCCTAGAGAGGAACAGTACAACTCCACCTACCGGGT GGTGTCCGTGCTGACCGTGCTGCACCAGGATTGGCTGAAC GGCAAAGAGTACAAGTGCAAGGTGTCCAACAAGGCCCTG GGAGCCCCCATCGAAAAGACCATCTCCAAGGCCAAGGGC CAGCCTCGCGAGCCTCAGGTGTACACCCTGCCCCCTAGCA GAGATGAGCTGACCAAGAACCAGGTGTCCCTGACCTGTC TCGTGAAAGGCTTCTACCCCTCCGATATCGCCGTGGAATG GGAGAGCAACGGCCAGCCCGAGAACAACTACAAGACCAC CCCCCCTGTGCTGGACTCCGACGGCTCATTCTTCCTGTACT CTAAGCTGACAGTGGACAAGTCCCGGTGGCAGCAGGGCA ACGTGTTCTCCTGCTCCGTGATGCACGAGGCCCTGCACAA CCACTACACCCAGAAGTCCCTGTCCCTGTCTCCCGGGGGA GGCGGAGGATCTGGCGGAGGCGGATCCGGTGGTGGCGGA TCTGGGGGCGGTGGATCTGAGGTGCAGCTGCTGGAATCT GGGGGAGGACTGGTGCAGCCAGGCGGATCTCTGAGGCTG TCCTGCGCTGCTTCCGGCTTTACCTTCTCCAGCCACGCCAT GAGTTGGGTGCGCCAGGCACCCGGAAAAGGACTGGAATG GGTGTCAGCCATCTGGGCCTCCGGCGAGCAGTACTACGCC GATAGCGTGAAGGGCCGGTTCACCATCTCTCGGGATAAC AGCAAGAATACTCTGTACCTGCAGATGAACTCCCTGCGCG CTGAAGATACCGCTGTGTATTACTGCGCCAAGGGCTGGCT GGGCAACTTCGATTACTGGGGCCAGGGAACCCTCGTGAC TGTCTCGAGCGCTTCTGTGGCCGCTCCCTCCGTGTTCATCT TCCCACCTTCCGACGAGCAGCTGAAGTCCGGCACTGCCTC TGTCGTGTGCCTGCTGAACAACTTCTACCCTCGGGAAGCC AAGGTGCAGTGGAAAGTGGATAACGCCCTGCAGTCCGGC AACTCCCAGGAATCCGTGACCGAGCAGGACTCCAAGGAC AGCACCTACTCCCTGAGCAGCACCCTGACCCTGTCCAAGG CCGACTACGAGAAGCACAAGGTGTACGCCTGTGAAGTGA CCCACCAGGGCCTGTCCAGCCCCGTGACCAAGTCCTTCAA CCGGGGCGAGTGC |
| 267 | VLCL-Light chain 1 (11D5) (nucleotide sequence) | see Table 40 |
| 215 | VLCH1-Light chain 2 (28H1) (nucleotide sequence) | see above |
| 291 | (11D5) VHCH1-Heavy chain-(28H1) VHCL | QVQLVQSGAEVKKPGSSVKVSCKASGGTFSSYAISWVRQAP GQGLEWMGGIIPIFGTANYAQKFQGRVTITADKSTSTAYME LSSLRSEDTAVYYCARSTLIYGYPDYWGQGTTVTVSSASTK GPSVFPLAPSSKSTSGGTAALGCLVKDYFPEPVTVSWNSGAL TSGVHTFPAVLQSSGLYSLSSVVTVPSSSLGTQTYICNVNHK PSNTKVDKKVEPKSCDKTHTCPPCPAPEAAGGPSVFLFPPKP |

TABLE 60-continued

Sequences of bispecific, bivalent anti-4-1BB/anti-FAP human IgG1 P329GLALA antigen binding molecules

| SEQ ID NO: | Description | Sequence |
|---|---|---|
| | | KDTLMISRTPEVTCVVVDVSHEDPEVKFNWYVDGVEVHNA KTKPREEQYNSTYRVVSVLTVLHQDWLNGKEYKCKVSNKA LGAPIEKTISKAKGQPREPQVYTLPPSRDELTKNQVSLTCLV KGFYPSDIAVEWESNGQPENNYKTTPPVLDSDGSFFLYSKLT VDKSRWQQGNVFSCSVMHEALHNHYTQKSLSLSPGGGGGS GGGGSGGGGSGGGGSEVQLLESGGGLVQPGGSLRLSCAAS GFTFSSHAMSWVRQAPGKGLEWVSAIWASGEQYYADSVKG RFTISRDNSKNTLYLQMNSLRAEDTAVYYCAKGWLGNFDY WGQGTLVTVSSASVAAPSVFIFPPSDEQLKSGTASVVCLLNN FYPREAKVQWKVDNALQSGNSQESVTEQDSKDSTYSLSSTL TLSKADYEKHKVYACEVTHQGLSSPVTKSFNRGEC |
| 269 | VLCL-Light chain 1 (11D5) | see Table 40 |
| 217 | VLCH1-Light chain 2 (28H1) | see above |
| 292 | (9B11) VHCH1-Heavy chain-(28H1) VHCL (nucleotide sequence) | CAGGTGCAATTGGTGCAGTCTGGGGCTGAGGTGAAGAAG CCTGGGTCCTCGGTGAAGGTCTCCTGCAAGGCCTCCGGAG GCACATTCAGCAGCTACGCTATAAGCTGGGTGCGACAGG CCCCTGGACAAGGGCTCGAGTGGATGGGAGGGATCATCC CTATCTTTGGTACAGCAAACTACGCACAGAAGTTCCAGGG CAGGGTCACCATTACTGCAGACAAATCCACGAGCACAGC CTACATGGAGCTGAGCAGCCTGAGATCTGAGGACACCGC CGTGTATTACTGTGCGAGATCTTCTGGTGCTTACCCGGGT TACTTCGACTACTGGGGCCAAGGGACCACCGTGACCGTCT CCTCAGCTAGCACCAAGGGCCCATCCGTGTTCCCTCTGGC CCCTTCCAGCAAGTCTACCTCTGGCGGCACAGCCGCTCTG GGCTGCCTCGTGAAGGACTACTTCCCCGAGCCTGTGACAG TGTCCTGGAACTCTGGCGCCCTGACATCCGGCGTGCACAC CTTTCCAGCTGTGCTGCAGTCCTCCGGCCTGTACTCCCTGT CCTCCGTCGTGACAGTGCCCTCCAGCTCTCTGGGCACCCA GACCTACATCTGCAACGTGAACCACAAGCCCTCCAACAC CAAGGTGGACAAGAAGGTGGAACCCAAGTCCTGCGACAA GACCCACACCTGTCCCCCTTGTCCTGCCCCTGAAGCTGCT GGCGGCCCTAGCGTGTTCCTGTTCCCCCCAAAGCCCAAGG ACACCCTGATGATCTCCCGGACCCCCGAAGTGACCTGCGT GGTGGTGGATGTGTCCCACGAGGACCCTGAAGTGAAGTT CAATTGGTACGTGGACGGCGTGGAAGTGCACAATGCCAA GACCAAGCCTAGAGAGGAACAGTACAACTCCACCTACCG GGTGGTGTCCGTGCTGACCGTGCTGCACCAGGATTGGCTG AACGGCAAAGAGTACAAGTGCAAGGTGTCCAACAAGGCC CTGGGAGCCCCCATCGAAAAGACCATCTCCAAGGCCAAG GGCCAGCCTCGCGAGCCTCAGGTGTACACCCTGCCCCCTA GCAGAGATGAGCTGACCAAGAACCAGGTGTCCCTGACCT GTCTCGTGAAAGGCTTCTACCCCTCCGATATCGCCGTGGA ATGGGAGAGCAACGGCCAGCCCGAGAACAACTACAAGAC CACCCCCCCTGTGCTGGACTCCGACGGCTCATTCTTCCTG TACTCTAAGCTGACAGTGGACAAGTCCCGGTGGCAGCAG GGCAACGTGTTCTCCTGCTCCGTGATGCACGAGGCCCTGC ACAACCACTACACCCAGAAGTCCCTGTCCCTGTCTCCCGG GGGAGGCGGAGGATCTGGCGGAGGCGGATCCGGTGGTGG CGGATCTGGGGGCGGTGGATCTGAGGTGCAGCTGCTGGA ATCTGGGGGAGGACTGGTGCAGCCAGGCGGATCTCTGAG GCTGTCCTGCGCTGCTTCCGGCTTTACCTTCTCCAGCCACG CCATGAGTTGGGTGCGCCAGGCACCGGAAAAGGACTGG AATGGGTGTCAGCCATCTGGGCCTCCGGCGAGCAGTACT ACGCCGATAGCGTGAAGGGCCGGTTCACCATCTCTCGGG ATAACAGCAAGAATACTCTGTACCTGCAGATGAACTCCCT GCGCGCTGAAGATACCGCTGTGTATTACTGCGCCAAGGG CTGGCTGGGCAACTTCGATTACTGGGGCCAGGGAACCCTC GTGACTGTCTCGAGCGCTTCTGTGGCCGCTCCCTCCGTGT TCATCTTCCCACCTTCCGACGAGCAGCTGAAGTCCGGCAC TGCCTCTGTCGTGTGCCTGCTGAACAACTTCTACCCCTCGG GAAGCCAAGGTGCAGTGGAAAGTGGATAACGCCCTGCAG TCCGGCAACTCCCAGGAATCCGTGACCGAGCAGGACTCC AAGGACAGCACCTACTCCCTGAGCAGCACCCTGACCCTGT CCAAGGCCGACTACGAGAAGCACAAGGTGTACGCCTGTG AAGTGACCCACCAGGGCCTGTCCAGCCCCGTGACCAAGT CCTTCAACCGGGGCGAGTGC |

TABLE 60-continued

Sequences of bispecific, bivalent anti-4-1BB/anti-FAP human IgG1 P329GLALA antigen binding molecules

| SEQ ID NO: | Description | Sequence |
|---|---|---|
| 271 | VLCL-Light chain 1 (9B11) (nucleotide sequence) | see Table 40 |
| 215 | VLCH1-Light chain 2 (9B11) (nucleotide sequence) | see above |
| 293 | (9B11) VHCH1- Heavy chain- (28H1) VHCL | QVQLVQSGAEVKKPGSSVKVSCKASGGTFSSYAISWVRQAP GQGLEWMGGIIPIFGTANYAQKFQGRVTITADKSTSTAYME LSSLRSEDTAVYYCARSSGAYPGYFDYWGQGTTVTVSSAST KGPSVFPLAPSSKSTSGGTAALGCLVKDYFPEPVTVSWNSG ALTSGVHTFPAVLQSSGLYSLSSVVTVPSSSLGTQTYICNVN HKPSNTKVDKKVEPKSCDKTHTCPPCPAPEAAGGPSVFLFPP KPKDTLMISRTPEVTCVVVDVSHEDPEVKFNWYVDGVEVH NAKTKPREEQYNSTYRVVSVLTVLHQDWLNGKEYKCKVSN KALGAPIEKTISKAKGQPREPQVYTLPPSRDELTKNQVSLTC LVKGFYPSDIAVEWESNGQPENNYKTTPPVLDSDGSFFLYSK LTVDKSRWQQGNVFSCSVMHEALHNHYTQKSLSLSPGGGG GSGGGGSGGGGSGGGGSEVQLLESGGGLVQPGGSLRLSCA ASGFTFSSHAMSWVRQAPGKGLEWVSAIWASGEQYYADSV KGRFTISRDNSKNTLYLQMNSLRAEDTAVYYCAKGWLGNF DYWGQGTLVTVSSASVAAPSVFIFPPSDEQLKSGTASVVCLL NNFYPREAKVQWKVDNALQSGNSQESVTEQDSKDSTYSLSS TLTLSKADYEKHKVYACEVTHQGLSSPVTKSFNRGEC |
| 273 | VLCL-Light chain 1 (9B11) | see Table 40 |
| 217 | VLCH1-Light chain 2 (9B11) | see above |

All genes were transiently expressed under control of a chimeric MPSV promoter consisting of the MPSV core promoter combined with the CMV promoter enhancer fragment. The expression vector also contains the oriP region for episomal replication in EBNA (Epstein Barr Virus Nuclear Antigen) containing host cells.

The bispecific anti-4-1BB/anti-FAP constructs were produced by co-transfecting HEK293-EBNA cells with the mammalian expression vectors using polyethylenimine. The cells were transfected with the corresponding expression vectors in a 1:1:1 ratio ("vector heavy chain":"vector light chain1":"vector light chain2").

For production in 500 mL shake flasks, 400 million HEK293 EBNA cells were seeded 24 hours before transfection. For transfection cells were centrifuged for 5 minutes by 210×g, and supernatant was replaced by pre-warmed CD CHO medium. Expression vectors were mixed in 20 mL CD CHO medium to a final amount of 200 µg DNA. After addition of 540 µL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% $CO_2$ atmosphere. After the incubation, 160 mL F17 medium was added and cells were cultured for 24 hours. One day after transfection 1 mM valproic acid and 7% Feed were added. After culturing for 7 days, the cell supernatant was collected by centrifugation for 15 minutes at 210×g. The solution was sterile filtered (0.22 µm filter), supplemented with sodium azide to a final concentration of 0.01% (w/v), and kept at 4° C.

Purification of bispecific constructs from cell culture supernatants was carried out by affinity chromatography using Protein A as described above for purification of antigen-Fc fusions and antibodies.

The protein was concentrated and filtered prior to loading on a HiLoad Superdex 200 column (GE Healthcare) equilibrated with 20 mM Histidine, 140 mM NaCl solution of pH 6.0.

The protein concentration of purified bispecific constructs was determined by measuring the OD at 280 nm, using the molar extinction coefficient calculated on the basis of the amino acid sequence. Purity and molecular weight of the bispecific constructs were analyzed by CE-SDS in the presence and absence of a reducing agent (Invitrogen, USA) using a LabChipGXII (Caliper). The aggregate content of bispecific constructs was analyzed using a TSKgel G3000 SW XL analytical size-exclusion column (Tosoh) equilibrated in a 25 mM $K_2HPO_4$, 125 mM NaCl, 200 mM L-Arginine Monohydrocloride, 0.02% (w/v) $NaN_3$, pH 6.7 running buffer at 25° C. (Table 61).

TABLE 61

Biochemical analysis of bispecific, bivalent anti-4-1BB/anti-FAP IgG1 P329G LALA antigen binding molecules

| Clone | Monomer [%] | Yield [mg/l] |
|---|---|---|
| 12B3/FAP P329GLALA IgG1 2 + 2 | 97.6 | 6.8 |

TABLE 61-continued

Biochemical analysis of bispecific, bivalent anti-4-1BB/anti-FAP
IgG1 P329G LALA antigen binding molecules

| Clone | Monomer [%] | Yield [mg/l] |
|---|---|---|
| 25G7/FAP P329GLALA IgG1 2 + 2 | 98.4 | 13 |
| 11D5/FAP P329GLALA IgG1 2 + 2 | 100 | 8.7 |
| 9B11/FAP P329GLALA IgG1 2 + 2 | 99 | 0.3 |

9.2 Binding of Bispecific Bivalent Antibodies Targeting 4-1BB and FAP 9.2.1 Surface Plasmon Resonance (Simultaneous Binding)

The capacity of binding simultaneously human 4-1BB Fc(kih) and human FAP was assessed by surface plasmon resonance (SPR). All SPR experiments were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany).

Biotinylated human 4-1BB Fc(kih) was directly coupled to a flow cell of a streptavidin (SA) sensor chip. Immobilization levels up to 1000 resonance units (RU) were used. The bispecific antibodies targeting 4-1BB and FAP were passed at a concentration range of 250 nM with a flow of 30 µL/minute through the flow cells over 90 seconds and dissociation was set to zero sec. Human FAP was injected as second analyte with a flow of 30 µL/minute through the flow cells over 90 seconds at a concentration of 250 nM (FIG. 34B). The dissociation was monitored for 120 sec. Bulk refractive index differences were corrected for by subtracting the response obtained in a reference flow cell, where no protein was immobilized. All bispecific constructs could bind simultaneously human 4-1BB and human FAP (FIGS. 35A-35D).

9.2.2 Binding on Cells 9.2.2.1 Binding on Human 4-1BB Expressing Cells: Resting and Activated Human Peripheral Mononuclear Blood Leukocytes (PBMC)

Human PBMCs were isolated, activated to induce 4-1BB and used to test binding properties of antibodies to human 4-1BB as already described under Example 7.1.2.

To show that Fc-fused FAP-targeting does not influence the binding of the anti-4-1BB specific clones or the detection via PE-conjugated human IgG Fc-specific goat IgG F(ab'), we tested the binding capacity of FAP-targeted or DP47-untargeted 2+2 constructs compared to the parental huIgG P329G LALA formats to resting human CD4$^+$ and CD8$^+$ T cells (FIGS. 38A-38F) and activated human CD4$^+$ and CD8$^+$ T cells (FIGS. 39A-39F). Similar to FIG. 23 also the FAP-targeted or DP47-targeted 2+2 human 4-1BB-specific molecules did not bind to resting T cells (FIGS. 38A-38F) but mainly to activated CD8$^+$ T cells (FIGS. 39 D, 39E and 39F). The conversion into the FAP-targeting or DP47-non-targeting 2+2 formats did not change the binding behaviour to 4-1BB-expressing T cells dramatically. Differences may be explained by the detection with Fc-specific polyclonal secondary antibody (e.g. Fc-fusion may mask epitopes and reduce the detection). EC$_{50}$ values varied from donor to donor depending on the amount of expressed 4-1BB after the activation. This explains the difference of EC$_{50}$ values listed in Table 62 compared with those of the parental antibodies as shown in Table 48. Area under the curve of binding to activated CD8$^+$ T cells are shown in FIG. 40.

TABLE 62

EC$_{50}$ values of binding to activated human CD8 T cells

| Clone | EC$_{50}$ [nM] |
|---|---|
| 25G7 | 11.14 |
| 25G7/FAP 28H1 2 + 2 | 13.21 |
| 25G7/DP47 2 + 2 | 50.03 |
| 12B3 | 0.43 |
| 12B3/FAP 28H1 2 + 2 | 1.99 |
| 11D5 | 1.35 |
| 11D5/FAP 28H1 2 + 2 | 7.91 |

9.2.2.2 Binding to Human FAP-expressing Tumor Cells

For binding assays on cell-surface expressed Fibroblast Activation Protein (FAP) NIH/3T3-huFAP clone 19 cell line or human melanoma cell line WM-266-4 (ATCC CRL-1676) were used. NIH/3T3-huFAP clone 19 was generated by transfection of mouse embryonic fibroblast NIH/3T3 cells (ATCC CRL-1658) with the expression pETR4921 plasmid encoding human FAP under a CMV promoter. Cells were maintained in the presence of 1.5 µg/mL puromycin (InvivoGen, Cat.-No.: ant-pr-5). 2×10$^5$ of FAP expressing tumor cells were added to each well of a round-bottom suspension cell 96-well plates (Greiner bio-one, cellstar, Cat.-No. 650185). Cells were washed once with 200 µL DPBS, resuspended in 100 µL/well of 4° C. cold DPBS buffer containing 1:5000 diluted Fixable Viability Dye eFluor 450 (eBioscience, Cat. No. 65 0863 18) or Fixable Viability Dye eFluor 660 (eBioscience, Cat.-No. 65-0864-18) and incubated for 30 minutes at 4° C. Cells were washed once with 200 µL 4° C. cold DPBS buffer, resuspended in 50 µL/well of 4° C. cold FACS buffer containing different titrated concentrations of 4-1BB-specific FAP-targeted and non-targeted antibodies followed by an incubation for 1 hour at 4° C. After washing four times with 200 µL/well, cells were stained with 50 µL/well of 4° C. cold FACS buffer containing 2.5 µg/mL PE-conjugated AffiniPure anti-human IgG Fcγ-fragment-specific goat F(ab')2 fragment (Jackson ImmunoResearch, Cat.-No. 109-116-098) or 30 µg/mL FITC-conjugated AffiniPure anti-human IgG Fcγ-fragment-specific goat F(ab')2 fragment (Jackson ImmunoResearch, Cat. No. 109 096 098) for 30 minutes at 4° C. Cells were washed twice with 200 µL 4° C. FACS buffer and cells were resuspended in 50 µL/well DPBS containing 1% formaldehyde for fixation. The same or next day cells were resuspended in 100 µL FACS-buffer and acquired using 5-laser LSR-Fortessa (BD Bioscience with DIVA software) or MACSQuant Analyzer 10 (Miltenyi Biotec).

Figure 42:
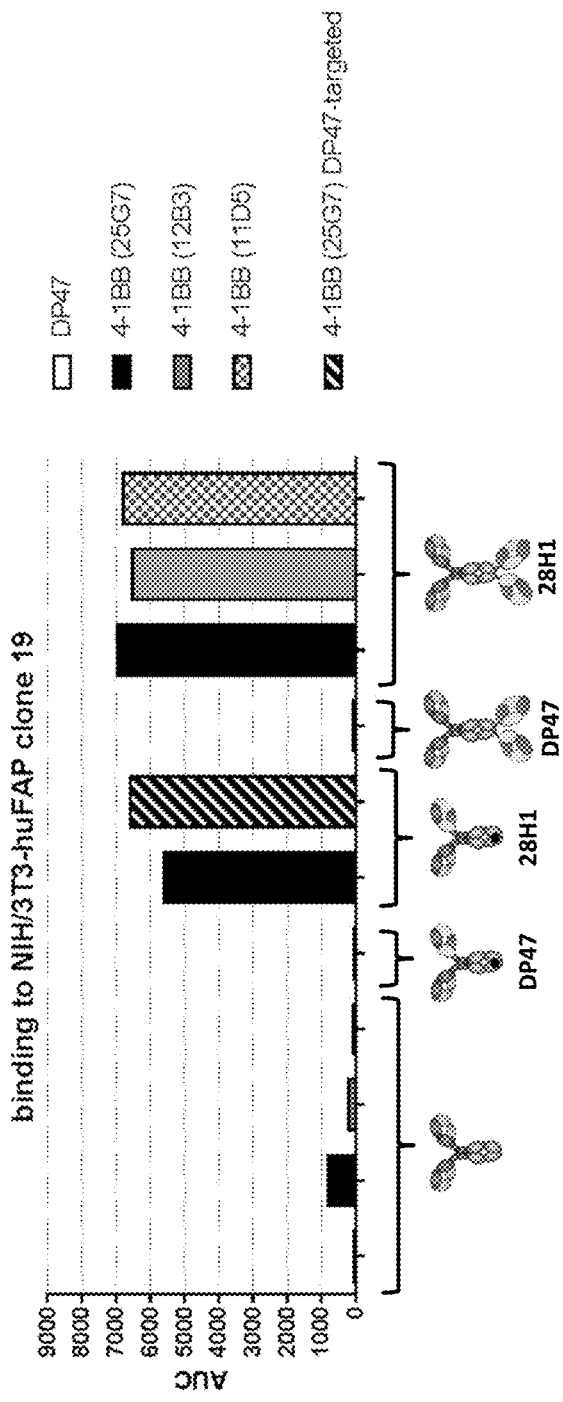
FIG. 42 summarizes the binding to NIH/3T3-huFAP cells. Shown is the area under the curve (AUC) of the binding curves. Used antibody formats are indicated as pictograms under the graph, the 4-1BB-binding clones are indicated by the column color: DP47 control molecule in white, 25G7 containing molecules in black, if DP47-untargeted in black with white stripes, clone 11D5 in grey and clone 12B3 in white/black-check. The graph shows that only FAP-targeted molecules but not their 4-1BB-binding parental huIgG1 P329G LALA nor the DP47-targeted 4-1BB (25G7)-binding molecules can bind to FAP-expressing cells.

As shown in FIGS. 41A-41F, all tested 2+2 FAP-targeted molecules, but not the DP47-targeted or parental huIgG1 P293G LALA formats containing the 4-1BB-binding clone 25G7, 11D5 and 12B3 clones bind efficiently and to human FAP-expressing cells. Therefore the tested FAP (28H1)-targeted 2+2 constructs can specifically bind to FAP-expressing cells. In FIG. 42 a summary as area under (AUC) the curve of NIH/3T3-huFAP binding curves is shown. Tested formats and FAP-binding clones are indicated below the graph as pictogram. It shows that all tested FAP-targeted 2+2 formats show a similar AUC.

TABLE 63

EC$_{50}$ values of binding to FAP expressing
cell line NIH/3T3-huFAP clone 19 and WM-266-4

| Clone | EC$_{50}$ [nM] with NIH/3T3-huFAP clone 19 cells | EC$_{50}$ [nM] with WM-266-4 |
|---|---|---|
| 12B3/FAP 28H1 2 + 2 | 12 | n.d. |
| 25G7/FAP 28H1 2 + 2 | 0.4 | n.d. |
| 11D5/FAP 28H1 2 + 2 | 0.9 | 0.7 |
| 25G7/DP47 2 + 2 | 0.4 | n.d. |

9.2.3 NFκB Activation 9.2.3.1 Generation of HeLa Cells Expressing Human 4-1BB and NF-κB-luciferase The cervix carcinoma cell line HeLa (ATCC CCL-2) was transduced with a plasmid based on the expression vector pETR10829, which contains the sequence of human 4-1BB (Uniprot accession Q07011) under control of a CMV-promoter and a puromycin resistance gene. Cells were cultured in DMEM medium supplemented with 10% (v/v) FBS, 1% (v/v) GlutaMAX-I and 3 µg/mL puromycin.

4-1BB-transduced HeLa cells were tested for 4-1BB expression by flow cytometry: $0.2 \times 10^6$ living cells were resuspended in 100 µL FACS buffer containing 0.1 µg PerCP/Cy5.5 conjugated anti-human 4-1BB mouse IgG1κ clone 4B4-1 (BioLegend Cat. No. 309814) or its isotype control (PerCP/Cy5.5 conjugated mouse IgG1κ isotype control antibody clone MOPC 21, BioLegend Cat. No. 400150) and incubated for 30 minutes at 4° C. Cells were washed twice with FACS buffer, resuspended in 300 µL FACS buffer containing 0.06 µg DAPI (Santa Cruz Biotec, Cat. No. Sc-3598) and acquired using a 5-laser LSR-Fortessa (BD Bioscience, DIVA software). Limited dilutions were performed to generate single clones as described: human-4-1BB-transduced HeLa cells were resuspended in medium to a density of 10, 5 and 2.5 cells/ml and 200 µl of cell suspensions were transferred to round bottom tissue-culture treated 96-well plates (6 plates/cell concentration, TPP Cat. No. 92697). Single clones were harvested, expanded and tested for 4-1BB expression as described above. The clone with the highest expression of 4-1BB (clone 5) was chosen for subsequent transfection with the NF-kB-luciferase expression-vector 5495p Tranlucent HygB. The vector confers transfected cells both with resistance to Hygromycin B and capacity to express luciferase under control of NF-kB-response element (Panomics, Cat. No. LR0051). For transfection human-4-1BB HeLa clone 5 cells were cultured to 70% confluence. 50 µg (40 µL) linearized (restriction enzymes AseI and SalI) 5495p Tranlucent HygB expression vector were added to a sterile 0.4 cm Gene Pulser/Micro-Pulser Cuvette (Biorad, Cat.-No, 165-2081). $2.5 \times 10^6$ human-4-1BB HeLa clone 5 cells in 400 µl supplement-free DMEM medium were added and mixed carefully with the plasmid solution. Transfection of cells was performed using a Gene Pulser Xcell total system (Biorad, Cat No. 165 2660) under the following settings: exponential pulse, capacitance 500 µF, voltage 160 V, resistance ∞. Immediately after the pulse transfected cells were transferred to a 75 cm² cm tissue culture flask (TPP, Cat. No. 90075) with 15 mL 37° C. warm DMEM medium supplied with 10% (v/v) FBS and 1% (v/v) GlutaMAX I. On the next day, culture medium containing 3 µg/mL Puromycin and 200 µg/mL Hygromycin B (Roche, Cat. No. 10843555001) was added. Surviving cells were expanded and limited dilution was performed as described above to generate single clones.

Clones were tested for 4-1BB expression as described above and for NF-κB-Luciferase activity as following: Clones were harvested in selection medium and counted using a Cell Counter Vi-cell xr 2.03 (Beckman Coulter, Cat. No. 731050). Cells were set to a cell density of $0.33 \times 10^6$ cells/mL and 150 µL of this cell suspension were transferred to each well of a sterile white 96-well flat bottom tissue culture plate with lid (greiner bio one, Cat. No. 655083). Cells were incubated at 37° C. and 5% CO$_2$ overnight in a cell incubator (Hera Cell). The next day 50 µL of medium containing different concentrations of recombinant human tumor necrosis factor alpha (rhTNFα, PeproTech, Cat.-No. 300 01A) were added to each well of a 96-well plate resulting in final concentration of rhTNFα of 100, 50, 25, 12.5, 6.25 and 0 ng/well. Cells were incubated for 6 hours at 37° C. and 5% CO$_2$ and then washed three times with 200 µL/well DPBS. Reporter Lysis Buffer (Promega, Cat-No: E3971) was added to each well (40 µl) and the plates were stored over night at −20° C. The next day frozen cell and Detection Buffer (Luciferase 1000 Assay System, Promega, Cat. No. E4550) were thawed to room temperature. 100 uL of detection buffer were added to each well and the plate was measured as fast as possible using a SpectraMax M5/M5e microplate reader and the SoftMax Pro Software (Molecular Devices). Measured units of released light for 500 ms/well (URLs) above control (no rhTNFα added) were taken as luciferase activity. The HeLa-hu4-1BB-NF-κB-luc clone 26 exhibiting the highest luciferase activity and a considerable level of 4-1BB-expression and was chosen for further use.

9.2.3.2 NFκB Activation in HeLa Cells Expressing Human 4-1BB Reporter Cells Co-cultured with FAP-expressing Tumor Cells HeLa-hu4-1BB-NF-κB-luc clone 26 cells were harvested and resuspended in DMEM medium supplied with 10% (v/v) FBS and 1% (v/v) GlutaMAX-I to a concentration of $0.2 \times 10^6$ cells/ml. 100 µl ($2 \times 10^4$ cells) of this cell suspension were transferred to each well of a sterile white 96-well flat bottom tissue culture plate with lid (greiner bio one, Cat. No. 655083) and the plate were incubated at 37° C. and 5% CO$_2$ overnight. The next day 50 µL of medium containing titrated FAP-targeted anti-human 4-1BB constructs or their parental huIgG1 P329G LALA antibodies were added. FAP-expressing NIH/3T3-huFAP clone 19 or WM-266-4 were resuspended in DMEM medium supplied with 10% (v/v) FBS and 1% (v/v) GlutaMAX-I to a concentration of $2 \times 10^6$ cells/ml.

Suspension of FAP-expressing tumor cell (50 µl) or medium as negative control (no FAP$^+$ tumor cells) were added to each well and plates were incubated for 6 hours at 37° C. and 5% CO$_2$ in the cell incubator. Cells were washed twice with 200 µL/well DPBS. 40 µl freshly prepared Reporter Lysis Buffer (Promega, Cat-No: E3971) were added to each well and the plate were stored over night at −20° C. The next day frozen cell plate and Detection Buffer (Luciferase 1000 Assay System, Promega, Cat. No. E4550) were thawed to room temperature. 100 µL of detection buffer were added to each well and luciferase activity was measured as fast as possible using a SpectraMax M5/M5e microplate reader and a SoftMax Pro Software (Molecular Devices).

FAP (28H1)-targeted clone 25G7, 11D5 or 12B3 2+2 constructs triggered activation of the NFκB signaling pathway in the reporter cell line in the presence of NIH/3T3-huFAP cells (FIGS. 43C, 43F and 43I) in a concentration-dependend manner. In contrast, the untargeted control molecule (4-1BB (25G7)×DP47 2+2) or the parental huIgG1 P329G LALA antibodies failed to trigger such an effect at any of the tested concentrations. This activity of tested FAP-targeted anti-human 4-1BB 2+2 antibodies was strictly dependent on a high expression of FAP at the cell surface of added crosslinking cells as no NF-κB activation could be detected in the absence FAP-expressing tumor cells (FIGS. 43 A, 43D and 43G) or in the presence of a tumor cell line expressing less FAP (WM-266-4) (FIGS. 43B, 43E and 43H). Therefore the activation depends on the FAP-expression strength and not on affinity strength of the anti-4-1BB binder because the activation potency between 25G7×FAP 2+2, 11D5×FAP 2+2 and 12B3×FAP 2+2 (FIGS. 44A and 44B and Table 64) do not correlate with their 4-1BB binding affinity (FIG. 42).

TABLE 64

$EC_{50}$ values of activation of the NFκB-controlled Luciferase in 4-1BB expressing reporter cell lines in the presence of FAP-expressing NIH/3T3-huFAP clone 19 cells

| Clone | $EC_{50}$ [nM] with NIH/3T3-huFAP clone 19 |
|---|---|
| 12B3/FAP 28H1 2 + 2 | 0.2 |
| 11D5/FAP 28H1 2 + 2 | 0.2 |
| 25G7/FAP 28H1 2 + 2 | 0.1 |

Example 10

Preparation, Purification and Characterization of Bispecific Monovalent Antibodies Targeting 4-1BB and a Tumor Associated Antigen (TAA)

10.1 Generation of Bispecific Antibodies Targeting 4-1BB and Fibroblast Activation Protein (FAP) in Monovalent Format (1+1 Format)

Bispecific agonistic 4-1BB antibodies with monovalent binding for 4-1BB and for FAP were prepared. The cross mab technology was applied to reduce the formation of wrongly paired light chains as described in International patent application No. WO 2010/145792 A1.

The generation and preparation of the FAP binders is described in WO 2012/020006 A2, which is incorporated herein by reference.

Figure 34C:
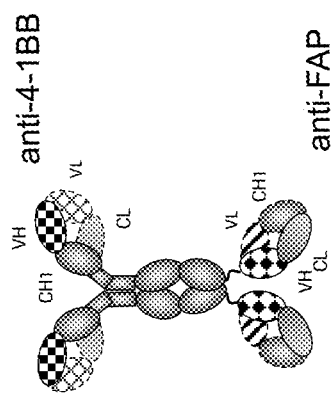
FIG. 34C shows a schematic scheme of an exemplary bispecific, monovalent antigen binding molecule of the invention comprising one Fab fragment binding to 4-1BB and one cross-Fab fragment binding to FAP (1+1 format).
Figure 34B:
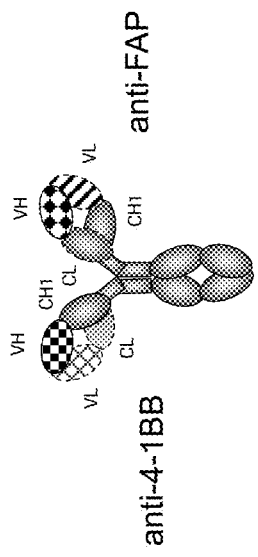
FIG. 34B shows the setup for the SPR experiments showing simultaneous binding to immobilized human 4-1BB and human FAP is shown.

The bispecific construct binds monovalently to 4-1BB and to FAP (FIG. 34C). It contains a crossed Fab unit (VHCL) of the FAP binder fused to the knob heavy chain of an anti-4-1BB huIgG1 (containing the S354C/T366W mutations). The Fc hole heavy chain (containing the Y349C/T366S/L368A/Y407V mutations) is fused to a Fab against anti-4-1BB. Combination of the targeted anti-FAP-Fc knob with the anti-4-1BB-Fc hole chain allows generation of a heterodimer, which includes a Fab that specifically binds to FAP and a Fab that specifically binds to 4-1BB.

The Pro329Gly, Leu234Ala and Leu235Ala mutations have been introduced in the constant region of the knob and hole heavy chains to abrogate binding to Fc gamma receptors according to the method described in International Patent Appl. Publ. No. WO 2012/130831 A1.

The bispecific monovalent anti-4-1BB and anti-FAP huIgG1 P329GLALA were produced by co-transfecting HEK293-EBNA cells with the mammalian expression vectors using polyethylenimine. The cells were transfected with the corresponding expression vectors in a 1:1:1:1 ratio ("vector knob heavy chain":"vector light chain1":"vector hole heavy chain":"vector light chain2").

The resulting bispecific, monovalent constructs were produced and purified as described for the bispecific bivalent anti-4-1BB and anti-FAP huIgG1 P329GLALA (see Example 9.1). The nucleotide and amino acid sequences can be found in Table 65.

TABLE 65 cDNA and amino acid sequences of mature bispecific monovalent anti-4-1BB/anti-FAP huIgG1 P329GLALA kih antibodies

| SEQ ID NO: | Description | Sequence |
|---|---|---|
| 228 | (28H1) VHCL-heavy chain hole (nucleotide sequence) | GAAGTGCAGCTGCTGGAATCCGGCGGAGGCCTGGTGC AGCCTGGCGGATCTCTGAGACTGTCCTGCGCCGCCTCC GGCTTCACCTTCTCCTCCCACGCCATGTCCTGGGTCCG ACAGGCTCCTGGCAAAGGCCTGGAATGGGTGTCCGCC ATCTGGGCCTCCGGCGAGCAGTACTACGCCGACTCTGT GAAGGGCCGGTTCACCATCTCCCGGGACAACTCCAAG AACACCCTGTACCTGCAGATGAACTCCCTGCGGGCCGA GGACACCGCCGTGTACTACTGTGCCAAGGGCTGGCTGG GCAACTTCGACTACTGGGGACAGGGCACCCTGGTCACC GTGTCCAGCGCTAGCGTGGCCGCTCCCAGCGTGTTCAT CTTCCCACCCAGCGACGAGCAGCTGAAGTCCGGCACA GCCAGCGTGGTGTGCCTGCTGAACAACTTCTACCCCCG CGAGGCCAAGGTGCAGTGGAAGGTGGACAACGCCCTG CAGAGCGGCAACAGCCAGGAATCCGTGACCGAGCAGG ACAGCAAGGACTCCACCTACAGCCTGAGCAGCACCCT GACCCTGAGCAAGGCCGACTACGAGAAGCACAAGGTG TACGCCTGCGAAGTGACCCACCAGGGCCTGTCCAGCCC CGTGACCAAGAGCTTCAACCGGGGCGAGTGCGACAAG ACCCACACCTGTCCCCCTTGCCCTGCCCCTGAAGCTGC TGGTGGCCCTTCCGTGTTCCTGTTCCCCCCAAAGCCCA AGGACACCCTGATGATCAGCCGGACCCCCGAAGTGAC CTGCGTGGTGGTCGATGTGTCCCACGAGGACCCTGAAG TGAAGTTCAATTGGTACGTGGACGGCGTGGAAGTGCA CAATGCCAAGACCAAGCCGCGGGAGGAGCAGTACAAC AGCACGTACCGTGTGGTCAGCGTCCTCACCGTCCTGCA CCAGGACTGGCTGAATGGCAAGGAGTACAAGTGCAAG GTCTCCAACAAAGCCCTCGGCGCCCCCATCGAGAAAA |

TABLE 65-continued cDNA and amino acid sequences of mature bispecific monovalent
anti-4-1BB/anti-FAP huIgG1 P329GLALA kih antibodies

| SEQ ID NO: | Description | Sequence |
|---|---|---|
| | | CCATCTCCAAAGCCAAAGGGCAGCCCCGAGAACCACA GGTGTGCACCCTGCCCCCATCCCGGGATGAGCTGACCA AGAACCAGGTCAGCCTCTCGTGCGCAGTCAAAGGCTTC TATCCCAGCGACATCGCCGTGGAGTGGGAGAGCAATG GGCAGCCGGAGAACAACTACAAGACCACGCCTCCCGT GCTGGACTCCGACGGCTCCTTCTTCCTCGTGAGCAAGC TCACCGTGGACAAGAGCAGGTGGCAGCAGGGGAACGT CTTCTCATGCTCCGTGATGCATGAGGCTCTGCACAACC ACTACACGCAGAAGAGCCTCTCCCTGTCTCCGGGTAAA |
| 215 | (28H1) VLCH1-Light chain 2 (nucleotide sequence) | GAGATCGTGCTGACCCAGTCTCCCGGCACCCTGAGCCT GAGCCCTGGCGAGAGAGCCACCCTGAGCTGCAGAGCC AGCCAGAGCGTGAGCCGGAGCTACCTGGCCTGGTATC AGCAGAAGCCCGGCCAGGCCCCCAGACTGCTGATCAT CGGCGCCAGCACCCGGGCCACCGGCATCCCCGATAGA TTCAGCGGCAGCGGCTCCGGCACCGACTTCACCCTGAC CATCAGCCGGCTGGAACCCGAGGACTTCGCCGTGTACT ACTGCCAGCAGGGCCAGGTGATCCCCCCCACCTTCGGC CAGGGCACCAAGGTGGAAATCAAGAGCTCCGCTAGCA CCAAGGGCCCCTCCGTGTTTCCTCTGGCCCCCAGCAGC AAGAGCACCTCTGGCGGAACAGCCGCCCTGGGCTGCC TGGTGAAAGACTACTTCCCCGAGCCCGTGACCGTGTCC TGGAACTCTGGCGCCCTGACCAGCGGCGTGCACACCTT TCCAGCCGTGCTGCAGAGCAGCGGCCTGTACTCCCTGA GCAGCGTGGTGACAGTGCCCTCCAGCAGCCTGGGCAC CCAGACCTACATCTGCAACGTGAACCACAAGCCCAGC AACACCAAAGTGGACAAGAAGGTGGAACCCAAGAGCT GCGAC |
| 229 | (28H1) VHCL-heavy chain hole | EVQLLESGGGLVQPGGSLRLSCAASGFTFSSHAMSWVRQ APGKGLEWVSAIWASGEQYYADSVKGRFTISRDNSKNTL YLQMNSLRAEDTAVYYCAKGWLGNFDYWGQGTLVTVS SASVAAPSVFIFPPSDEQLKSGTASVVCLLNNFYPREAKV QWKVDNALQSGNSQESVTEQDSKDSTYSLSSTLTLSKAD YEKHKVYACEVTHQGLSSPVTKSFNRGECDKTHTCPPCP APEAAGGPSVFLFPPKPKDTLMISRTPEVTCVVVDVSHED PEVKFNWYVDGVEVHNAKTKPREEQYNSTYRVVSVLTV LHQDWLNGKEYKCKVSNKALGAPIEKTISKAKGQPREPQ VCTLPPSRDELTKNQVSLSCAVKGFYPSDIAVEWESNGQP ENNYKTTPPVLDSDGSFFLVSKLTVDKSRWQQGNVFSCS VMHEALHNHYTQKSLSLSPGK |
| 217 | (28H1) VLCH1-Light chain 2 | EIVLTQSPGTLSLSPGERATLSCRASQSVSRSYLAWYQQK PGQAPRLLIIGASTRATGIPDRFSGSGSGTDFTLTISRLEPE DFAVYYCQQGQVIPPTFGQGTKVEIKSSASTKGPSVFPLA PSSKSTSGGTAALGCLVKDYFPEPVTVSWNSGALTSGVH TFPAVLQSSGLYSLSSVVTVPSSSLGTQTYICNVNHKPSNT KVDKKVEPKSCD |
| 294 | (12B) VHCH1-heavy chain knob (nucleotide sequence) | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTCGAGTGGATGGGAGG GATCATCCCTATCTTTGGTACAGCAAACTACGCACAGA AGTTCCAGGGCAGGGTCACCATTACTGCAGACAAATCC ACGAGCACAGCCTACATGGAGCTGAGCAGCCTGAGAT CTGAGGACACCGCCGTGTATTACTGTGCGAGATCTGAA TTCCGTTTCTACGCTGACTTCGACTACTGGGGCCAAGG GACCACCGTGACCGTCTCCTCAGCTAGCACCAAGGGCC CTAGCGTGTTCCCTCTGGCCCCTAGCAGCAAGAGCACA AGTGGAGGAACAGCCGCCCTGGGCTGCCTGGTCAAGG ACTACTTCCCCGAGCCCGTGACCGTGTCCTGGAATTCT GGCGCCCTGACAAGCGGCGTGCACACATTTCCAGCCGT GCTGCAGAGCAGCGGCCTGTACTCTCTGAGCAGCGTCG TGACCGTGCCCTCTAGCTCTCTGGGCACCCAGACCTAC ATCTGCAACGTGAACCACAAGCCCAGCAACACCAAAG TGGACAAGAAGGTGGAACCCAAGAGCTGCGACAAGAC CCACACCTGTCCCCCTTGCCCTGCCCCTGAAGCTGCTG GTGCCCTTCCGTGTTCCTGTTCCCCCCAAAGCCCAAG GACACCCTGATGATCAGCCGGACCCCCGAAGTGACCT GCGTGGTGGTCGATGTGTCCCACGAGGACCCTGAAGTG AAGTTCAATTGGTACGTGGACGGCGTGGAAGTGCACA ATGCCAAGACCAAGCCGCGGGAGGAGCAGTACAACAG CACGTACCGTGTGGTCAGCGTCCTCACCGTCCTGCACC |

TABLE 65-continued cDNA and amino acid sequences of mature bispecific monovalent
anti-4-1BB/anti-FAP huIgG1 P329GLALA kih antibodies

| SEQ ID NO: | Description | Sequence |
|---|---|---|
|  |  | AGGACTGGCTGAATGGCAAGGAGTACAAGTGCAAGGT<br>CTCCAACAAAGCCCTCGGCGCCCCCATCGAGAAAACC<br>ATCTCCAAAGCCAAAGGGCAGCCCCGAGAACCACAGG<br>TGTACACCCTGCCCCCATGCCGGGATGAGCTGACCAAG<br>AACCAGGTCAGCCTGTGGTGCCTGGTCAAAGGCTTCTA<br>TCCCAGCGACATCGCCGTGGAGTGGGAGAGCAATGGG<br>CAGCCGGAGAACAACTACAAGACCACGCCTCCCGTGC<br>TGGACTCCGACGGCTCCTTCTTCCTCTACAGCAAGCTC<br>ACCGTGGACAAGAGCAGGTGGCAGCAGGGGAACGTCT<br>TCTCATGCTCCGTGATGCATGAGGCTCTGCACAACCAC<br>TACACGCAGAAGAGCCTCTCCCTGTCTCCGGGTAAA |
| 259 | (12B3) VLCL-Light chain 1 (nucleotide sequence) | see Table 40 |
| 295 | (12B3) VHCH1-heavy chain knob | QVQLVQSGAEVKKPGSSVKVSCKASGGTFSSYAISWVRQ<br>APGQGLEWMGGIIPIFGTANYAQKFQGRVTITADKSTSTA<br>YMELSSLRSEDTAVYYCARSEFRFYADFDYWGQGTTVT<br>VSSASTKGPSVFPLAPSSKSTSGGTAALGCLVKDYFPEPV<br>TVSWNSGALTSGVHTFPAVLQSSGLYSLSSVVTVPSSSLG<br>TQTYICNVNHKPSNTKVDKKVEPKSCDKTHTCPPCPAPE<br>AAGGPSVFLFPPKPKDTLMISRTPEVTCVVVDVSHEDPEV<br>KFNWYVDGVEVHNAKTKPREEQYNSTYRVVSVLTVLHQ<br>DWLNGKEYKCKVSNKALGAPIEKTISKAKGQPREPQVYT<br>LPPCRDELTKNQVSLWCLVKGFYPSDIAVEWESNGQPEN<br>NYKTTPPVLDSDGSFFLYSKLTVDKSRWQQGNVFSCSVM<br>HEALHNHYTQKSLSLSPGK |
| 261 | (12B3) VLCL-Light chain 1 | see Table 40 |
| 296 | (25G7) VHCH1-heavy chain knob (nucleotide sequence) | GAGGTGCAATTGTTGGAGTCTGGGGGAGGCTTGGTAC<br>AGCCTGGGGGGTCCCTGAGACTCTCCTGTGCAGCCTCC<br>GGATTCACCTTTAGCAGTTATGCCATGAGCTGGGTCCG<br>CCAGGCTCCAGGGAAGGGGCTGGAGTGGGTCTCAGCT<br>ATTAGTGGTAGTGGTGGTAGCACATACTACGCAGACTC<br>CGTGAAGGGCCGGTTCACCATCTCCAGAGACAATTCCA<br>AGAACACGCTGTATCTGCAGATGAACAGCCTGAGAGC<br>CGAGGACACGGCCGTATATTACTGTGCGCGTGACGACC<br>CGTGGCCGCCGTTCGACTACTGGGGCCAAGGAACCCTG<br>GTCACCGTCTCGAGTGCTAGCACCAAGGGCCCTAGCGT<br>GTTCCCTCTGGCCCCTAGCAGCAAGAGCACAAGTGGA<br>GGAACAGCCGCCCTGGGCTGCCTGGTCAAGGACTACTT<br>CCCCGAGCCCGTGACCGTGTCCTGGAATTCTGGCGCCC<br>TGACAAGCGGCGTGCACACATTTCCAGCCGTGCTGCAG<br>AGCAGCGGCCTGTACTCTCTGAGCAGCGTCGTGACCGT<br>GCCCTCTAGCTCTCTGGGCACCCAGACCTACATCTGCA<br>ACGTGAACCACAAGCCCAGCAACACCAAAGTGGACAA<br>GAAGGTGGAACCCAAGAGCTGCGACAAGACCCACACC<br>TGTCCCCCTTGCCCTGCCCCTGAAGCTGCTGGTGGCCC<br>TTCCGTGTTCCTGTTCCCCCCAAAGCCCAAGGACACCC<br>TGATGATCAGCCGGACCCCCGAAGTGACCTGCGTGGTG<br>GTCGATGTGTCCCACGAGGACCCTGAAGTGAAGTTCAA<br>TTGGTACGTGGACGGCGTGGAAGTGCACAATGCCAAG<br>ACCAAGCCGCGGGAGGAGCAGTACAACAGCACGTACC<br>GTGTGGTCAGCGTCCTCACCGTCCTGCACCAGGACTGG<br>CTGAATGGCAAGGAGTACAAGTGCAAGGTCTCCAACA<br>AAGCCCTCGGCGCCCCCATCGAGAAAACCATCTCCAA<br>AGCCAAAGGGCAGCCCCGAGAACCACAGGTGTACACC<br>CTGCCCCCATGCCGGGATGAGCTGACCAAGAACCAGG<br>TCAGCCTGTGGTGCCTGGTCAAAGGCTTCTATCCCAGC<br>GACATCGCCGTGGAGTGGGAGAGCAATGGGCAGCCGG<br>AGAACAACTACAAGACCACGCCTCCCGTGCTGGACTCC<br>GACGGCTCCTTCTTCCTCTACAGCAAGCTCACCGTGGA<br>CAAGAGCAGGTGGCAGCAGGGGAACGTCTTCTCATGC<br>TCCGTGATGCATGAGGCTCTGCACAACCACTACACGCA<br>GAAGAGCCTCTCCCTGTCTCCGGGTAAA |
| 263 | (25G7) VLCL-Light chain 1 (nucleotide sequence) | see Table 40 |

TABLE 65-continued cDNA and amino acid sequences of mature bispecific monovalent
anti-4-1BB/anti-FAP huIgG1 P329GLALA kih antibodies

| SEQ ID NO: | Description | Sequence |
|---|---|---|
| 297 | (25G7) VHCH1-heavy chain knob | EVQLLESGGGLVQPGGSLRLSCAASGFTFSSYAMSWVRQ APGKGLEWVSAISGSGGSTYYADSVKGRFTISRDNSKNTL YLQMNSLRAEDTAVYYCARDDPWPPFDYWGQGTLVTV SSASTKGPSVFPLAPSSKSTSGGTAALGCLVKDYFPEPVT VSWNSGALTSGVHTFPAVLQSSGLYSLSSVVTVPSSSLGT QTYICNVNHKPSNTKVDKKVEPKSCDKTHTCPPCPAPEA AGGPSVFLFPPKPKDTLMISRTPEVTCVVVDVSHEDPEVK FNWYVDGVEVHNAKTKPREEQYNSTYRVVSVLTVLHQD WLNGKEYKCKVSNKALGAPIEKTISKAKGQPREPQVYTL PPCRDELTKNQVSLWCLVKGFYPSDIAVEWESNGQPENN YKTTPPVLDSDGSFFLYSKLTVDKSRWQQGNVFSCSVMH EALHNHYTQKSLSLSPGK |
| 265 | (25G7) VLCL-Light chain 1 | see Table 40 |
| 298 | (11D5) VHCH1-heavy chain knob (nucleotide sequence) | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTCGAGTGGATGGGAGG GATCATCCCTATCTTTGGTACAGCAAACTACGCACAGA AGTTCCAGGGCAGGGTCACCATTACTGCAGACAAATCC ACGAGCACAGCCTACATGGAGCTGAGCAGCCTGAGAT CTGAGGACACCGCCGTGTATTACTGTGCGAGATCTACT CTGATCTACGGTTACTTCGACTACTGGGGCCAAGGGAC CACCGTGACCGTCTCCTCA GCTAGCACCAAGGGCCCTAGCGTGTTCCCTCTGGCCCC TAGCAGCAAGAGCACAAGTGGAGGAACAGCCGCCCTG GGCTGCCTGGTCAAGGACTACTTCCCCGAGCCCGTGAC CGTGTCCTGGAATTCTGGCGCCCTGACAAGCGGCGTGC ACACATTTCCAGCCGTGCTGCAGAGCAGCGGCCTGTAC TCTCTGAGCAGCGTCGTGACCGTGCCCTCTAGCTCTCT GGGCACCCAGACCTACATCTGCAACGTGAACCACAAG CCCAGCAACACCAAAGTGGACAAGAAGGTGGAACCCA AGAGCTGCGACAAGACCCACACCTGTCCCCCTTGCCCT GCCCCTGAAGCTGCTGGTGGCCCTTCCGTGTTCCTGTTC CCCCCAAAGCCCAAGGACACCCTGATGATCAGCCGGA CCCCCGAAGTGACCTGCGTGGTGGTCGATGTGTCCCAC GAGGACCCTGAAGTGAAGTTCAATTGGTACGTGGACG GCGTGGAAGTGCACAATGCCAAGACCAAGCCGCGGGA GGAGCAGTACAACAGCACGTACCGTGTGGTCAGCGTC CTCACCGTCCTGCACCAGGACTGGCTGAATGGCAAGG AGTACAAGTGCAAGGTCTCCAACAAAGCCCTCGGCGC CCCCATCGAGAAAACCATCTCCAAAGCCAAAGGGCAG CCCCGAGAACCACAGGTGTACACCCTGCCCCCATGCCG GGATGAGCTGACCAAGAACCAGGTCAGCCTGTGGTGC CTGGTCAAAGGCTTCTATCCCAGCGACATCGCCGTGGA GTGGGAGAGCAATGGGCAGCCGGAGAACAACTACAAG ACCACGCCTCCCGTGCTGGACTCCGACGGCTCCTTCTT CCTCTACAGCAAGCTCACCGTGGACAAGAGCAGGTGG CAGCAGGGGAACGTCTTCTCATGCTCCGTGATGCATGA GGCTCTGCACAACCACTACACGCAGAAGAGCCTCTCCC TGTCTCCGGGTAAA |
| 267 | (11D5) VLCL-Light chain 1 (nucleotide sequence) | see Table 40 |
| 299 | (11D5) VHCH1-heavy chain knob | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCARSTLIYGYFDYWGQGTTVTVS SASTKGPSVFPLAPSSKSTSGGTAALGCLVKDYFPEPVTV SWNSGALTSGVHTFPAVLQSSGLYSLSSVVTVPSSSLGTQ TYICNVNHKPSNTKVDKKVEPKSCDKTHTCPPCPAPEAA GGPSVFLFPPKPKDTLMISRTPEVTCVVVDVSHEDPEVKF NWYVDGVEVHNAKTKPREEQYNSTYRVVSVLTVLHQD WLNGKEYKCKVSNKALGAPIEKTISKAKGQPREPQVYTL PPCRDELTKNQVSLWCLVKGFYPSDIAVEWESNGQPENN YKTTPPVLDSDGSFFLYSKLTVDKSRWQQGNVFSCSVMH EALHNHYTQKSLSLSPGK |

TABLE 65-continued cDNA and amino acid sequences of mature bispecific monovalent
anti-4-1BB/anti-FAP_huIgG1_P329GLALA_kih antibodies

| SEQ ID NO: | Description | Sequence |
|---|---|---|
| 269 | (11D5) VLCL-Light chain 1 | see Table 40 |
| 300 | (9B11) VHCH1-heavy chain knob (nucleotide sequence) | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTCGAGTGGATGGGAGG GATCATCCCTATCTTTGGTACAGCAAACTACGCACAGA AGTTCCAGGGCAGGGTCACCATTACTGCAGACAAATCC ACGAGCACAGCCTACATGGAGCTGAGCAGCCTGAGAT CTGAGGACACCGCCGTGTATTACTGTGCGAGATCTTCT GGTGCTTACCCGGGTTACTTCGACTACTGGGGCCAAGG GACCACCGTGACCGTCTCCTCAGCTAGCACCAAGGGCC CTAGCGTGTTCCCTCTGGCCCCTAGCAGCAAGAGCACA AGTGGAGGAACAGCCGCCCTGGGCTGCCTGGTCAAGG ACTACTTCCCCGAGCCCGTGACCGTGTCCTGGAATTCT GGCGCCCTGACAAGCGGCGTGCACACATTTCCAGCCGT GCTGCAGAGCAGCGGCCTGTACTCTCTGAGCAGCGTCG TGACCGTGCCCTCTAGCTCTCTGGGCACCCAGACCTAC ATCTGCAACGTGAACCACAAGCCCAGCAACACCAAAG TGGACAAGAAGGTGGAACCCAAGAGCTGCGACAAGAC CCACACCTGTCCCCCTTGCCCTGCCCTGAAGCTGCTG GTGGCCCTTCCGTGTTCCTGTTCCCCCCAAAGCCCAAG GACACCCTGATGATCAGCCGGACCCCCGAAGTGACCT GCGTGGTGGTCGATGTGTCCCACGAGGACCCTGAAGTG AAGTTCAATTGGTACGTGGACGGCGTGGAAGTGCACA ATGCCAAGACCAAGCCGCGGGAGGAGCAGTACAACAG CACGTACCGTGTGGTCAGCGTCCTCACCGTCCTGCACC AGGACTGGCTGAATGGCAAGGAGTACAAGTGCAAGGT CTCCAACAAAGCCCTCGGCGCCCCCATCGAGAAAACC ATCTCCAAAGCCAAAGGGCAGCCCCGAGAACCACAGG TGTACACCCTGCCCCCATGCCGGGATGAGCTGACCAAG AACCAGGTCAGCCTGTGGTGCCTGGTCAAAGGCTTCTA TCCCAGCGACATCGCCGTGGAGTGGGAGAGCAATGGG CAGCCGGAGAACAACTACAAGACCACGCCTCCCGTGC TGGACTCCGACGGCTCCTTCTTCCTCTACAGCAAGCTC ACCGTGGACAAGAGCAGGTGGCAGCAGGGGAACGTCT TCTCATGCTCCGTGATGCATGAGGCTCTGCACAACCAC TACACGCAGAAGAGCCTCTCCCTGTCTCCGGGTAAA |
| 271 | (9B11) VLCL-Light chain 1 (nucleotide sequence) | see Table 40 |
| 301 | (9B11) VHCH1-heavy chain knob | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCARSSGAYPGYFDYWGQGTTVT VSSASTKGPSVFPLAPSSKSTSGGTAALGCLVKDYFPEPV TVSWNSGALTSGVHTFPAVLQSSGLYSLSSVVTVPSSSLG TQTYICNVNHKPSNTKVDKKVEPKSCDKTHTCPPCPAPE AAGGPSVFLFPPKPKDTLMISRTPEVTCVVVDVSHEDPEV KFNWYVDGVEVHNAKTKPREEQYNSTYRVVSVLTVLHQ DWLNGKEYKCKVSNKALGAPIEKTISKAKGQPREPQVYT LPPCRDELTKNQVSLWCLVKGFYPSDIAVEWESNGQPEN NYKTTPPVLDSDGSFFLYSKLTVDKSRWQQGNVFSCSVM HEALHNHYTQKSLSLSPGK |
| 273 | (9B11) VLCL-Light chain 1 | see Table 40 |

All genes were transiently expressed under control of a chimeric MPSV promoter consisting of the MPSV core promoter combined with the CMV promoter enhancer fragment. The expression vector also contains the oriP region for episomal replication in EBNA (Epstein Barr Virus Nuclear Antigen) containing host cells.

The bispecific anti-4-1BB/anti-FAP constructs were produced by co-transfecting HEK293-EBNA cells with the mammalian expression vectors using polyethylenimine. The cells were transfected with the corresponding expression vectors in a 1:1:1:1 ratio ("vector heavy knob chain":"vector heavy hole chain":"vector light chain1":"vector light chain2").

For production in 500 mL shake flasks, 400 million HEK293 EBNA cells were seeded 24 hours before transfection. For transfection cells were centrifuged for 5 minutes by 210×g, and supernatant was replaced by pre-warmed CD CHO medium. Expression vectors were mixed in 20 mL CD CHO medium to a final amount of 200 µg DNA. After addition of 540 µL PEI, the solution was vortexed for 15 seconds and incubated for 10 minutes at room temperature. Afterwards, cells were mixed with the DNA/PEI solution, transferred to a 500 mL shake flask and incubated for 3 hours at 37° C. in an incubator with a 5% CO$_2$ atmosphere. After the incubation, 160 mL F17 medium was added and cells were cultured for 24 hours. One day after transfection 1 mM valproic acid and 7% Feed were added. After culturing for 7 days, the cell supernatant was collected by centrifugation for 15 minutes at 210×g. The solution was sterile filtered (0.22 µm filter), supplemented with sodium azide to a final concentration of 0.01% (w/v), and kept at 4° C.

Purification of bispecific constructs from cell culture supernatants was carried out by affinity chromatography using Protein A as described above for purification of antigen/Fc fusion molecules or antibodies. The protein concentration of purified bispecific constructs was determined by measuring the OD at 280 nm, using the molar extinction coefficient calculated on the basis of the amino acid sequence. Purity and molecular weight of the bispecific constructs were analyzed by CE-SDS in the presence and absence of a reducing agent (Invitrogen, USA) using a LabChipGXII (Caliper). The aggregate content of bispecific constructs was analyzed using a TSKgel G3000 SW XL analytical size-exclusion column (Tosoh) equilibrated in a 25 mM K2HPO4, 125 mM NaCl, 200 mM L-Arginine Monohydrocloride, 0.02% (w/v) NaN3, pH 6.7 running buffer at 25° C.

TABLE 66

Biochemical analysis of bispecific, monovalent anti-4-1BB/anti-FAP IgG1 P329G LALA antigen binding molecules

| Clone | Yield [mg/l] | Monomer [%] |
|---|---|---|
| 12B3/FAP P329GLALA IgG1 1 + 1 | 14 | 94.8 |
| 25G7/FAP P329GLALA IgG1 1 + 1 | 33 | 92.2 |

10.2 Preparation, Purification and Characterization of FAP Antigens as Screening Tools In order to test the binding to FAP, DNA sequences encoding the ectodomains of human, mouse or cynomolgus FAP fused to a C-terminal HisTag were cloned in an expression vector containing a chimeric MPSV promoter consisting of the MPSV core promoter combined with the CMV promoter enhancer fragment. The expression vector also contains the oriP region for episomal replication in EBNA (Epstein Barr Virus Nuclear Antigen) containing host cells. The amino acid and nucleotide sequences of a His-tagged human FAP ECD is shown in SEQ ID NOs 85 and 86, respectively. SEQ ID NOs 88 and 89 show the amino acid and nucleotide sequences, respectively, of a His-tagged mouse FAP ECD. SEQ ID NOs 90 and 91 show the amino acid and nucleotide sequences, respectively, of a His-tagged cynomolgus FAP ECD.

The FAP antigens were produced by co-transfecting HEK293-EBNA cells with the mammalian expression vectors using polyethylenimine (PEI; Polysciences Inc.).

For a 200 mL production in 500 mL shake flasks, 300 million HEK293 EBNA cells were seeded 24 hours before transfection in 100% F17+6 mM Glutamine. For transfection, 400 million cells were centrifuged for 5 minutes at 210×g, and supernatant was replaced by 20 mL pre-warmed CD-CHO medium (Gibco). Expression vectors were mixed in 20 mL CD-CHO medium to a final amount of 200 µg DNA. After addition of 540 µL PEI (1 mg/mL) (Polysciences Inc.), the solution was vortexed for 15 seconds and incubated for 10 minutes at room temperature. Afterwards, resuspended cells were mixed with the DNA/PEI solution, transferred to a 500 mL shake flask and incubated for 3 hours at 37° C. in an incubator with a 5% CO2 atmosphere and shaking at 165 rpm. After the incubation, 160 mL F17 medium and supplements (1 mM valproic acid, 5 g/l Pepsoy and 6 mM L-Glutamine) were added and cells cultivated for 24 hours. 24 h after transfection the cells were then supplement with an amino acid and glucose feed at 12% final volume (24 mL). After cultivation for 7 days, the cell supernatant was collected by centrifugation for 45 minutes at 2000-3000×g. The solution was sterile filtered (0.22 µm filter), supplemented with sodium azide to a final concentration of 0.01% (w/v), and kept at 4° C.

Purification of the antigens from cell culture supernatants was carried out in a two step purification with first an affinity chromatography step using either a 5 ml IMAC column (Roche) or a 5 ml NiNTA column (Qiagen) followed by a size exclusion chromatography using a HiLoad Superdex 200 column (GE Healthcare) equilibrated with 20 mM Histidine, 140 mM NaCl, pH6.0 or 2 mM MOPS 150 mM NaCl 0.02% NaN3 pH 7.3, respectively.

For affinity chromatography, using the IMAC column (Roche), equilibration was performed with 25 mM Tris-HCl, 500 mM sodium Chloride, 20 mM imidazole, pH8.0 for 8 CVs. The supernatant was loaded and unbound protein washed out by washing with 10 CVs of 25 mM Tris-HCl, 500 mM sodium Chloride, 20 mM imidazole, pH8.0. The bound protein was eluted using a linear gradient of 20 CVs (from 0-100%) of 25 mM Tris-HCl, 500 mM sodium Chloride, 500 mM imidazole, pH8.0 followed by a step at 100% for 8 CVs.

For the affinity chromatography using the NiNTA column (Qiagen), equilibration was performed with 50 mM Sodium Phosphate, 300 mM Sodium Chloride, pH8.0 for 8 CVs. The supernatant was loaded and unbound protein was removed by washing with 10 column volumes of 50 mM Sodium Phosphate, 300 mM Sodium Chloride, pH8.0. The bound protein was eluted using a linear gradient of 20 CVs (from 0 to 100%) of 50 mM Sodium Phosphate, 300 mM Sodium Chloride, 500 mM imidazole, pH7.4 followed by a step of 5CVs of 50 mM Sodium Phosphate, 300 mM Sodium Chloride, 500 mM imidazole, pH7.4. The column was then re-equilibrated with 8 CVs of 50 mM Sodium Phosphate, 300 mM Sodium Chloride, pH8.0.

The collected fractions were then supplemented with 1/10 (v/v) of 0.5 M EDTA, pH8.0. The protein was concentrated in Vivaspin columns (30 kD cut off, Sartorius) and filtered prior to loading on a HiLoad Superdex 200 column (GE Healthcare) equilibrated with 2 mM MOPS 150 mM NaCl 0.02% NaN3 pH 7.3 or 20 mM Histidine, 140 mM NaCl, pH6.0.

The protein concentration of purified antigens was determined by measuring the OD at 280 nm, using the molar extinction coefficient calculated on the basis of the amino acid sequence. Purity and molecular weight of the antigens were analyzed by CE-SDS in the presence and absence of a reducing agent (Invitrogen) using a LabChipGXII (Caliper). The aggregate content of the antigens was analyzed using a TSKgel G3000 SW XL analytical size-exclusion column (Tosoh) equilibrated in a 25 mM potassiumphosphate, 125 mM sodium chloride, 200 mM L-Arginine Monohydrocloride, 0.02% (w/v) NaN3, pH 6.7 running buffer at 25° C.

10.3 Binding of Bispecific Monovalent Antibodies Targeting 4-1BB and FAP

10.3.1 Surface Plasmon Resonance (Simultaneous Binding)

The capacity of binding simultaneously human 4-1BB Fc(kih) and human FAP was assessed by surface plasmon resonance (SPR). All SPR experiments were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany).

Biotinylated human 4-1BB Fc(kih) was directly coupled to a flow cell of a streptavidin (SA) sensor chip. Immobilization levels up to 1000 resonance units (RU) were used. The bispecific antibodies targeting 4-1BB and FAP were passed at a concentration range of 250 nM with a flow of 30 µL/minute through the flow cells over 90 seconds and dissociation was set to zero sec. Human FAP was injected as second analyte with a flow of 30 µL/minute through the flow cells over 90 seconds at a concentration of 250 nM. The dissociation was monitored for 120 sec. Bulk refractive index differences were corrected for by subtracting the response obtained in a reference flow cell, where no protein was immobilized. All bispecific constructs could bind simultaneously human 4-1BB and human FAP.

10.3.2 Binding on Cells

10.3.2.1 Binding on Human 4-1BB Expressing Cells: Resting and Activated Human Peripheral Mononuclear Blood Leukocytes (PBMC)

Human PBMCs were isolated, used freshly (e.g. resting T cells) or activated to induce 4-1BB and used to test binding properties of antibodies to human 4-1BB as already described under Example 7.1.2.

Figure 39A:
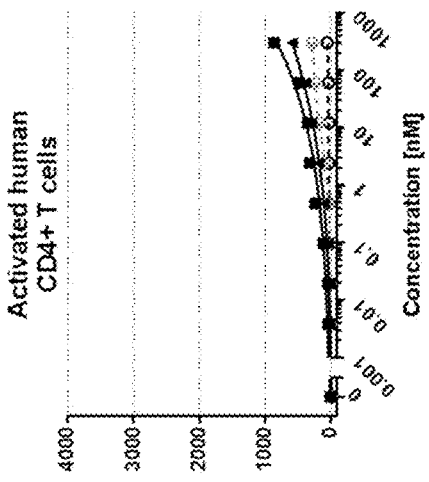
Figure 39B:
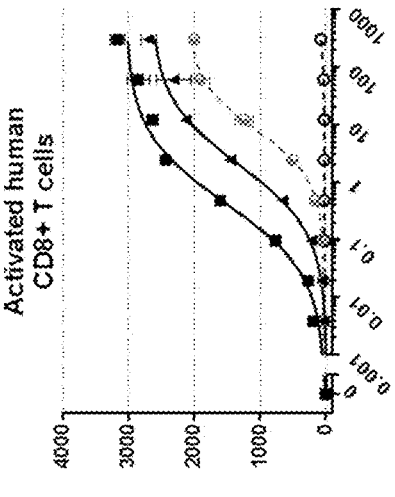
Figure 39C:
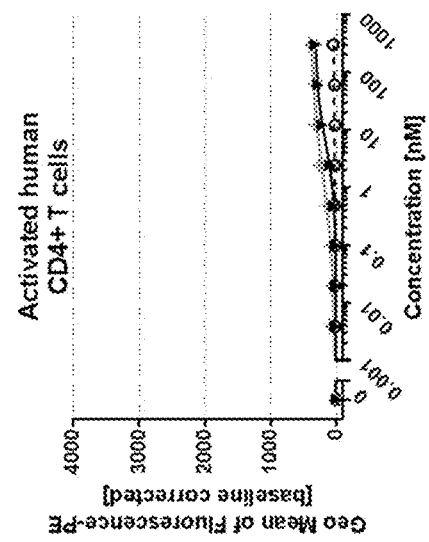
Figure 39D:
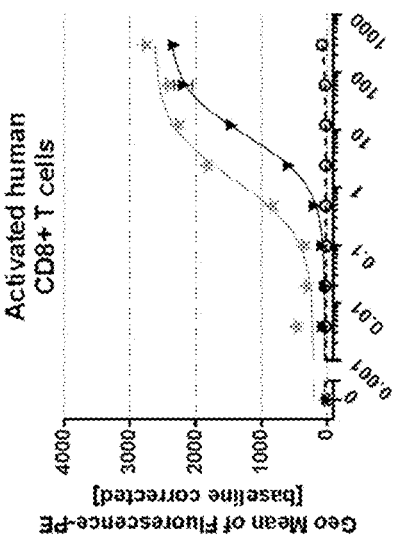
Figure 41E:
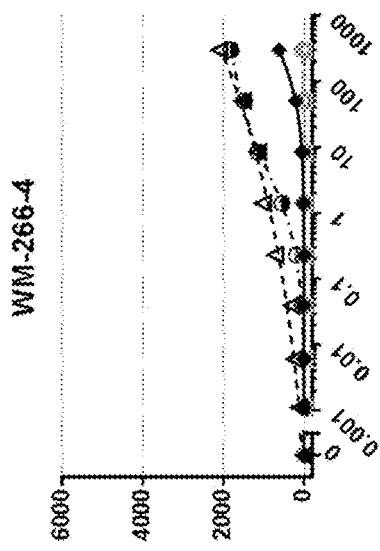
Figure 41F:
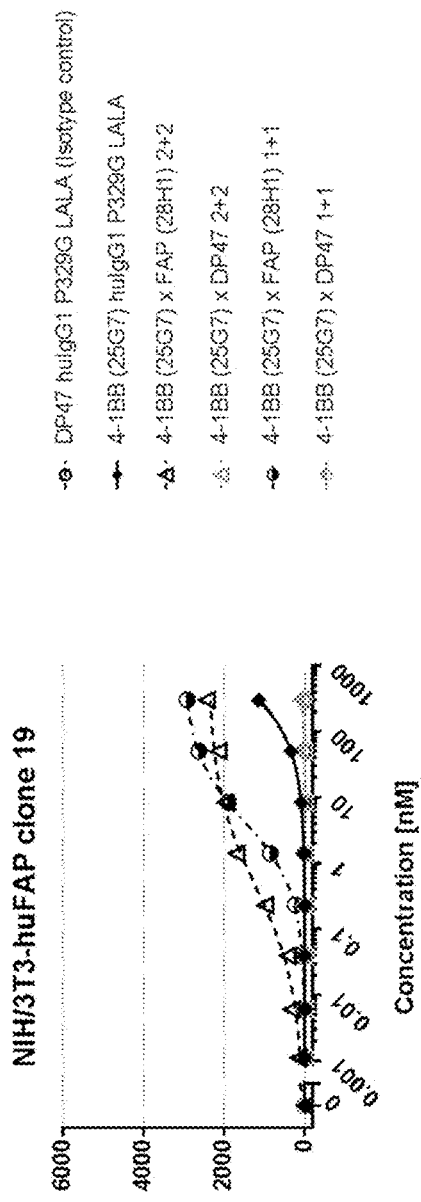

To compare monovalent 4-1BB-binding of 4-1BB FAP-targeted 1+1 constructs with the bivalent-4-1BB-binding of parental anti-4-1BB specific huIgG1 P329G LALA clones, constructs were incubated with resting or activated, human 4-1BB expressing PBMCs and detected with PE-conjugated human IgG Fc-specific goat IgG F(ab') as described earlier. As shown in FIGS. 39D and 39F, conversion into monovalent-4-1BB FAP-targeted 1+1 formats increased the $EC_{50}$ values of 4-1BB binding (Table 67) and decreased the MFI value (FIG. 39B/E and 39C/F) compared to their parental huIgG1 P329G LALA constructs. This increase of $EC_{50}$ and decrease of MFI lead to a more or less bisection of the area under the curve (AUC) of binding curves as shown in FIG. 40.

TABLE 67

$EC_{50}$ values of binding to activated human $CD8^+$ T cells

| Clone | $EC_{50}$ [nM] |
|---|---|
| 25G7 | 11.1 |
| 25G7/FAP 28H1 1 + 1 | >70 |
| 25G7/DP47 1 + 1 | >70 |
| 12B3 | 0.4 |
| 12B3/FAP 28H1 1 + 1 | 8 |

10.3.2.2 Binding to Human FAP-expressing Cells

The binding to FAP-expressing tumor cell has already been described above under 9.2.2.2.

As shown in FIG. 41, the FAP-targeted 1+1 molecules, but not the DP47-targeted 1+1 or parental huIgG1 P293G LALA antibodies of clones 25G7 and 12B3 bind efficiently to human FAP-expressing cells (FIGS. 41 B/D and 41E/F). Therefore also the 1+1 constructs can specifically bind to FAP-expressing cells, though due to the monovalent FAP-targeting with a slightly higher $EC_{50}$ than the FAP-targeted 2+2 formats (Table 68 and FIGS. 41 B/D and 41E/F). This however has only minimal effect on the AUC of the binding curves (FIG. 42).

TABLE 68

$EC_{50}$ values of binding to FAP expressing cell line NIH/3T3-huFAP clone 19 and WM-266-4

| Clone | $EC_{50}$ [nM] with NIH/3T3-huFAP clone 19 cells | $EC_{50}$ [nM] with WM-266-4 cells |
|---|---|---|
| 12B3/FAP 28H1 1 + 1 | 2.4 | 1.7 |
| 25G7/FAP 28H1 1 + 1 | 4.4 | 5 |
| 25G7/DP47 1 + 1 | n.d. | n.d. |

10.3.3. NFκB Activation

The protocol to analyze functional capacity using the human 4-1BB expressing reporter cell line HeLa-hu4-1BB-NFκB-luc has already been described in Example 9.2.3.2.

FAP (28H1)-targeted clone 25G7 or 12B3 1+1 constructs triggered activation of the NFκB signaling pathway in the reporter cell line in the presence of NIH/3T3-huFAP cells (FIGS. 43F and 43I). In contrast, the untargeted control molecule (4-1BB (25G7)×DP47 1+1) or the parental huIgG1 P329G LALA antibodies failed to trigger such an effect at any of the tested concentrations. This activity of FAP-targeted anti-human4-1BB 1+1 antibodies was strictly dependent on a high expression of FAP at the cell surface of added FAP+ cells as no NF-κB activation could be detected in the absence of FAP-expressing tumor cells (FIGS. 43D and 43G) or in the presence of a tumor cell line expressing less FAP (WM-266-4) (FIGS. 43E and 43H). Comparing FAP-targeted 1+1 with the FAP-targeted 2+2 molecules clone 12B3 and 25G7 are behaving differently. The 12B3 FAP-targeted 1+1 construct has a higher EC50 but also higher activation plateau than the 12B3 FAP-targeted 2+2 construct (FIG. 43F) and therefore both constructs have a similar AUC (FIG. 44A), whereas the 25G7 FAP-targeted 1+1 construct has a higher $EC_{50}$ value and the same activation plateau as the 25G7 FAP-targeted 2+2 construct (FIG. 44I) and therefore a smaller AUC (FIG. 44A) e.g. the 25G7 FAP-targeted 1+1 is clearly performing worse than the 25G7 FAP-targeted 2+2. Reasons could be the difference between strong (e.g. 12B3) and low (e.g. 25G7) 4-1BB binder which may become more pronound with a monovalent 4-1BB-binding.

TABLE 69

$EC_{50}$ values of activation of the NFκB signaling pathway in the presence of FAP-expressing tumor cells

| Clone | $EC_{50}$ [nM] with NIH/3T3-huFAP clone 19 |
|---|---|
| 12B3/FAP 28H1 1 + 1 | 0.9 |
| 25G7/FAP 28H1 1 + 1 | ~2 |

Example 11

Preparation, Purification and Characterization of Bispecific Antibodies with a Bivalent Binding to 4-1BB and a Monovalent Binding to Tumor Associated Antigen (TAA)

11.1. Generation of Bispecific Antibodies with a Bivalent Binding to 4-1BB and a Monovalent Binding to Tumor Associated Antigen (TAA) (2+1 Format)

Bispecific agonistic 4-1BB antibodies with bivalent binding for 4-1BB and monovalent binding for FAP, also termed 2+1, have been prepared as depicted in FIG. 36.

Figure 36A:
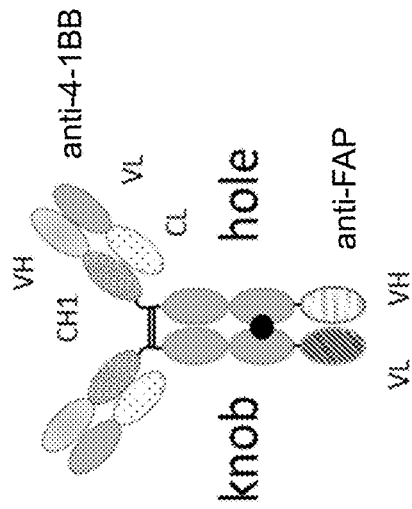
FIGS. 36A and 36B shows exemplary bispecific antigen binding molecules that are bivalent anti-4-1BB and monovalent anti-FAP huIgG1 P329GLALA, termed also 2+1 format. The bispecific antigen binding molecules comprise two Fab fragments binding to 4-1BB and a VH and VL domain binding to FAP.
Figure 36B:
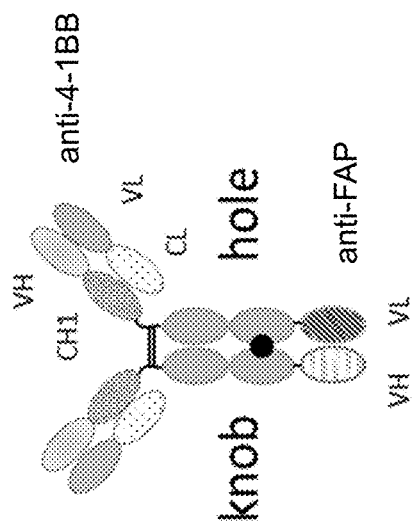

In this example, the first heavy chain HC1 of the construct was comprised of the following components: VHCH1 of anti-4-1BB binder, followed by Fc knob, at which C-terminus a VL or VH of anti-FAP binder was fused. The second heavy chain HC2 was comprised of VHCH1 of anti-4-1BB followed by Fc hole, at which C-terminus a VH or VL, respectively, of anti-FAP binder (clone 4B9) was fused. The generation and preparation of FAP binder 4B9 is described in WO 2012/020006 A2, which is incorporated herein by reference. Binders against 4-1BB(12B3, 9B11, 11D5 and 25G7), were generated as described in Example 6. Combination of the targeted anti-FAP-Fc knob with the anti-4-1BB-Fc hole chain allows generation of a heterodimer, which includes a FAP binding moiety and two 4-1BB binding Fabs (FIGS. 36A and 36B).

The Pro329Gly, Leu234Ala and Leu235Ala mutations have been introduced in the constant region of the knob and hole heavy chains to abrogate binding to Fcgamma receptors according to the method described in International Patent Appl. Publ. No.WO2012/130831A1.

The bispecific 2+1 anti-4-1BB anti-FAP huIgG1 P329GLALA antibodies were produced by co-transfecting HEK293-EBNA cells with the mammalian expression vectors using polyethylenimine. The cells were transfected with the corresponding expression vectors in a 1:1:1 ratio ("vector knob heavy chain":"vector light chain":"vector hole heavy chain"). The constructs were produced and purified as described for the bispecific bivalent anti-4-1BB and anti-FAP huIgG1 P329GLALA antibodies (see Example 9.1).

The base pair and amino acid sequences for 2+1 anti-4-1BB, anti-FAP constructs with a-FAP VH fused to knob and VL fused to hole chain can be found respectively in Table 70.

TABLE 70 cDNA and amino acid sequences of mature bispecific 2 + 1 anti-4-1BB, anti-FAP human IgG1 P329GLALA. (Constructs with a-FAP VL fused to hole and VH fused to knob chain, termed in Table 72 below hole-VL)

| SEQ ID NO: | Description | Sequence |
|---|---|---|
| 259 | (12B3) VLCL-light chain (nucleotide sequence) | GACATCCAGATGACCCAGTCTCCTTCCACCCTGTCTGC ATCTGTAGGAGACCGTGTCACCATCACTTGCCGTGCCA GTCAGAGTATTAGTAGCTGGTTGGCCTGGTATCAGCAG AAACCAGGGAAAGCCCCTAAGCTCCTGATCTATGATGC CTCCAGTTTGGAAAGTGGGGTCCCATCACGTTTCAGCG GCAGTGGATCCGGGACAGAATTCACTCTCACCATCAGC AGCTTGCAGCCTGATGATTTTGCAACTTATTACTGCCA ACAGTATCATTCGTATCCGCAGACGTTTGGCCAGGGCA CCAAAGTCGAGATCAAGCGTACGGTGGCTGCACCATCT GTCTTCATCTTCCCGCCATCTGATGAGCAGTTGAAATC TGGAACTGCCTCTGTTGTGTGCCTGCTGAATAACTTCT ATCCCAGAGAGGCCAAAGTACAGTGGAAGGTGGATAA CGCCCTCCAATCGGGTAACTCCCAGGAGAGTGTCACAG AGCAGGACAGCAAGGACAGCACCTACAGCCTCAGCAG CACCCTGACGCTGAGCAAAGCAGACTACGAGAAACAC AAAGTCTACGCCTGCGAAGTCACCCATCAGGGCCTGA GCTCGCCCGTCACAAAGAGCTTCAACAGGGGAGAGTG T |
| 316 | (12B3) VHCH1 Fc knob VH (4B9) (nucleotide sequence of HC 1) | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTGGAGTGGATGGGAGG GATCATCCCTATCTTTGGTACAGCAAACTACGCACAGA AGTTCCAGGGCAGGGTCACCATTACTGCAGACAAATCC ACGAGCACAGCCTACATGGAGCTGAGCAGCCTGAGAT CTGAGGACACCGCCGTGTATTACTGTGCGAGATCTGAA TTCCGTTTCTACGCTGACTTCGACTACTGGGGCCAAGG GACCACCGTGACCGTCTCGAGTGCTAGCACCAAGGGC CCATCGGTCTTCCCCCTGGCACCCTCCTCCAAGAGCAC CTCTGGGGGCACAGCGGCCCTGGGCTGCCTGGTCAAG GACTACTTCCCCGAACCGGTGACGGTGTCGTGGAACTC AGGCGCCCTGACCAGCGGCGTGCACACCTTCCCGGCTG TCCTACAGTCCTCAGGACTCTACTCCCTCAGCAGCGTG GTGACCGTGCCCTCCAGCAGCTTGGGCACCCAGACCTA CATCTGCAACGTGAATCACAAGCCCAGCAACACCAAG GTGGACAAGAAAGTTGAGCCCAAATCTTGTGACAAAA CTCACACATGCCCACCGTGCCCAGCACCTGAAGCTGCA GGGGGACCGTCAGTCTTCCTCTTCCCCCCAAAACCCAA GGACACCCTCATGATCTCCCGGACCCCTGAGGTCACAT GCGTGGTGGTGGACGTGAGCCACGAAGACCCTGAGGT CAAGTTCAACTGGTACGTGGACGGCGTGGAGGTGCAT AATGCCAAGACAAAGCCGCGGGAGGAGCAGTACAACA GCACGTACCGTGTGGTCAGCGTCCTCACCGTCCTGCAC CAGGACTGGCTGAATGGCAAGGAGTACAAGTGCAAGG TCTCCAACAAAGCCCTCGGCGCCCCCATCGAGAAAACC ATCTCCAAAGCCAAAGGGCAGCCCCGAGAACCACAGG TGTACACCCTGCCCCCCTGCAGAGATGAGCTGACCAAG AACCAGGTGTCCCTGTGGTGTCTGGTCAAGGGCTTCTA CCCCAGCGATATCGCCGTGGAGTGGGAGAGCAACGGC |

TABLE 70-continued cDNA and amino acid sequences of mature bispecific 2 + 1 anti-4-1BB, anti-FAP human IgG1 P329GLALA. (Constructs with a-FAP VL fused to hole and VH fused to knob chain, termed in Table 72 below hole-VL)

| SEQ ID NO: | Description | Sequence |
|---|---|---|
|  |  | CAGCCTGAGAACAACTACAAGACCACCCCCCCTGTGCT GGACAGCGACGGCAGCTTCTTCCTGTACTCCAAACTGA CCGTGGACAAGAGCCGGTGGCAGCAGGGCAACGTGTT CAGCTGCAGCGTGATGCACGAGGCCCTGCACAACCAC TACACCCAGAAGTCCCTGAGCCTGAGCCCCGGCGGAG GCGGCGGAAGCGGAGGAGGAGGATCTGGGGGCGGAG GTTCCGGAGGCGGTGGATCTGAGGTGCAGCTGCTCGA AAGCGGCGGAGGACTGGTGCAGCCTGGCGGCAGCCTG AGACTGTCTTGCGCCGCCAGCGGCTTCACCTTCAGCAG CTACGCCATGAGCTGGGTCCGCCAGGCCCCTGGCAAG GGACTGGAATGGGTGTCCGCCATCATCGGCTCTGGCGC CAGCACCTACTACGCCGACAGCGTGAAGGGCCGGTTC ACCATCAGCCGGGACAACAGCAAGAACACCCTGTACC TGCAGATGAACAGCCTGCGGGCCGAGGACACCGCCGT GTACTACTGCGCCAAGGGATGGTTCGGCGGCTTCAACT ACTGGGGACAGGGCACCCTGGTCACCGTGTCCAGC |
| 317 | (12B3) VHCH1 Fc hole VL (4B9) (nucleotide sequence of HC2) | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTGGAGTGGATGGGAGG GATCATCCCTATCTTTGGTACAGCAAACTACGCACAGA AGTTCCAGGGCAGGGTCACCATTACTGCAGACAAATCC ACGAGCACAGCCTACATGGAGCTGAGCAGCCTGAGAT CTGAGGACACCGCCGTGTATTACTGTGCGAGATCTGAA TTCCGTTTCTACGCTGACTTCGACTACTGGGGCCAAGG GACCACCGTGACCGTCTCGAGTGCTAGCACCAAGGGC CCATCGGTCTTCCCCCTGGCACCCTCCTCCAAGAGCAC CTCTGGGGGCACAGCGGCCCTGGGCTGCCTGGTCAAG GACTACTTCCCCGAACCGGTGACGGTGTCGTGGAACTC AGGCGCCCTGACCAGCGGCGTGCACACCTTCCCGGCTG TCCTACAGTCCTCAGGACTCTACTCCCTCAGCAGCGTG GTGACCGTGCCCTCCAGCAGCTTGGGCACCCAGACCTA CATCTGCAACGTGAATCACAAGCCCAGCAACACCAAG GTGGACAAGAAAGTTGAGCCCAAATCTTGTGACAAAA CTCACACATGCCCACCGTGCCCAGCACCTGAAGCTGCA GGGGGACCGTCAGTCTTCCTCTTCCCCCCAAAACCCAA GGACACCCTCATGATCTCCCGGACCCCTGAGGTCACAT GCGTGGTGGTGGACGTGAGCCACGAAGACCCTGAGGT CAAGTTCAACTGGTACGTGGACGGCGTGGAGGTGCAT AATGCCAAGACAAAGCCGCGGGAGGAGCAGTACAACA GCACGTACCGTGTGGTCAGCGTCCTCACCGTCCTGCAC CAGGACTGGCTGAATGGCAAGGAGTACAAGTGCAAGG TCTCCAACAAAGCCCTCGGCGCCCCCATCGAGAAAACC ATCTCCAAAGCCAAAGGGCAGCCCCGAGAACCACAGG TGTGCACCCTGCCCCCATCCCGGGATGAGCTGACCAAG AACCAGGTCAGCCTCTCGTGCGCAGTCAAAGGCTTCTA TCCCAGCGACATCGCCGTGGAGTGGGAGAGCAATGGG CAGCCGGAGAACAACTACAAGACCACGCCTCCCGTGC TGGACTCCGACGGCTCCTTCTTCCTCGTGAGCAAGCTC ACCGTGGACAAGAGCAGGTGGCAGCAGGGGAACGTCT TCTCATGCTCCGTGATGCATGAGGCTCTGCACAACCAC TACACGCAGAAGAGCCTCTCCCTGTCTCCGGGTGGAGG CGGCGGAAGCGGAGGAGGAGGATCCGGCGGCGGAGG TTCCGGAGGCGGAGGATCCGAGATCGTGCTGACCCAG TCTCCCGGCACCCTGTCTCTGAGCCCTGGCGAGAGAGC CACCCTGTCCTGCAGAGCCTCCCAGTCCGTGACCTCCT CCTACCTCGCCTGGTATCAGCAGAAGCCCGGCCAGGCC CCTCGGCTGCTGATCAACGTGGGCAGTCGGAGAGCCA CCGGCATCCCTGACCGGTTCTCCGGCTCTGGCTCCGGC ACCGACTTCACCCTGACCATCTCCCGGCTGGAACCCGA GGACTTCGCCGTGTACTACTGCCAGCAGGGCATCATGC TGCCCCCCACCTTTGGCCAGGGCACCAAGGTGGAAATC AAG |
| 261 | (12B3) VLCL-light chain | DIQMTQSPSTLSASVGDRVTITCRASQSISSWLAWYQQKP GKAPKLLIYDASSLESGVPSRFSGSGSGTEFTLTISSLQPDD FATYYCQQYHSYPQTFGQGTKVEIKRTVAAPSVFIFPPSD EQLKSGTASVVCLLNNFYPREAKVQWKVDNALQSGNSQ ESVTEQDSKDSTYSLSSTLTLSKADYEKHKVYACEVTHQ GLSSPVTKSFNRGEC |

TABLE 70-continued cDNA and amino acid sequences of mature bispecific 2 + 1 anti-4-1BB, anti-FAP human IgG1 P329GLALA. (Constructs with a-FAP VL fused to hole and VH fused to knob chain, termed in Table 72 below hole-VL)

| SEQ ID NO: | Description | Sequence |
| --- | --- | --- |
| 318 | (12B3) VHCH1 Fc knob VH (4B9) (heavy chain 1) | QVQLVQSGAEVKKPGSSVKVSCKASGGTFSSYAISWVRQ APQGQLEWMGGIIPIFGTANYAQKFQGRVTITADKSTSTA YMELSSLRSEDTAVYYCARSEFRFYADFDYWGQGTTVT VSSASTKGPSVFPLAPSSKSTSGGTAALGCLVKDYFPEPV TVSWNSGALTSGVHTFPAVLQSSGLYSLSSVVTVPSSSLG TQTYICNVNHKPSNTKVDKKVEPKSCDKTHTCPPCPAPE AAGGPSVFLFPPKPKDTLMISRTPEVTCVVVDVSHEDPEV KFNWYVDGVEVHNAKTKPREEQYNSTYRVVSVLTVLHQ DWLNGKEYKCKVSNKALGAPIEKTISKAKGQPREPQVYT LPPCRDELTKNQVSLWCLVKGFYPSDIAVEWESNGQPEN NYKTTPPVLDSDGSFFLYSKLTVDKSRWQQGNVFSCSVM HEALHNHYTQKSLSLSPGGGGSGGGGSGGGGSGGGGS EVQLLESGGGLVQPGGSLRLSCAASGFTFSSYAMSWVRQ APGKGLEWVSAIIGSGASTYYADSVKGRFTISRDNSKNTL YLQMNSLRAEDTAVYYCAKGWFGGFNYWGQGTLVTVS S |
| 319 | (12B3) VHCH1 Fc hole VL (4B9) (heavy chain 2) | QVQLVQSGAEVKKPGSSVKVSCKASGGTFSSYAISWVRQ APQGQLEWMGGIIPIFGTANYAQKFQGRVTITADKSTSTA YMELSSLRSEDTAVYYCARSEFRFYADFDYWGQGTTVT VSSASTKGPSVFPLAPSSKSTSGGTAALGCLVKDYFPEPV TVSWNSGALTSGVHTFPAVLQSSGLYSLSSVVTVPSSSLG TQTYICNVNHKPSNTKVDKKVEPKSCDKTHTCPPCPAPE AAGGPSVFLFPPKPKDTLMISRTPEVTCVVVDVSHEDPEV KFNWYVDGVEVHNAKTKPREEQYNSTYRVVSVLTVLHQ DWLNGKEYKCKVSNKALGAPIEKTISKAKGQPREPQVCT LPPSRDELTKNQVSLSCAVKGFYPSDIAVEWESNGQPENN YKTTPPVLDSDGSFFLVSKLTVDKSRWQQGNVFSCSVMH EALHNHYTQKSLSLSPGGGGSGGGGSGGGGSGGGGSEI VLTQSPGTLSLSPGERATLSCRASQSVTSSYLAWYQQKPG QAPRLLINVGSRRATGIPDRFSGSGSGTDFTLTISRLEPEDF AVYYCQQGIMLPPTFGQGTKVEIK |
| 263 | (25G7) VLCL-light chain (nucleotide sequence) | TCGTCTGAGCTGACTCAGGACCCTGCTGTGTCTGTGGC CTTGGGACAGACAGTCAGGATCACATGCCAAGGAGAC AGCCTCAGAAGTTATTATGCAAGCTGGTACCAGCAGA AGCCAGGACAGGCCCCTGTACTTGTCATCTATGGTAAA ACAACCGGCCCTCAGGGATCCCAGACCGATTCTCTGG CTCCAGCTCAGGAAACACAGCTTCCTTGACCATCACTG GGGCTCAGGCGGAAGATGAGGCTGACTATTACTGTAA CTCCCTTGATAGGCGCGGTATGTGGGTATTCGGCGGAG GGACCAAGCTGACCGTCCTAGGTCAACCCAAGGCTGC CCCCAGCGTGACCCTGTTCCCCCCCAGCAGCGAGGAAC TGCAGGCCAACAAGGCCACCCTGGTCTGCCTGATCAGC GACTTCTACCCAGGCGCCGTGACCGTGGCCTGGAAGGC CGACAGCAGCCCCGTGAAGGCCGGCGTGGAGACCACC ACCCCCAGCAAGCAGAGCAACAACAAGTACGCCGCCA GCAGCTACCTGAGCCTGACCCCCGAGCAGTGGAAGAG CCACAGGTCCTACAGCTGCCAGGTGACCCACGAGGGC AGCACCGTGGAGAAAACCGTGGCCCCCACCGAGTGCA GC |
| 320 | (25G7) VHCH1 Fc knob VH (4B9) (nucleotide sequence, heavy chain 1) | GAGGTGCAGCTGCTGGAATCTGGCGGCGGACTGGTGC AGCCTGGCGGATCTCTGAGACTGAGCTGTGCCGCCAGC GGCTTCACCTTCAGCAGCTACGCCATGAGCTGGGTGCG CCAGGCCCCTGGAAAAGGCCTGGAATGGGTGTCCGCC ATCTCTGGCAGCGGCGGCAGCACCTACTACGCCGATTC TGTGAAGGGCCGGTTCACCATCAGCCGGGACAACAGC AAGAACACCCTGTACCTGCAGATGAACAGCCTGCGGG CCGAGGACACCGCCGTGTACTATTGCGCCAGGGACGA CCCCTGGCCCCCCTTTGATTATTGGGGACAGGGCACCC TCGTGACCGTGTCCAGCGCTAGCACCAAGGGCCCATCG GTCTTCCCCCTGGCACCCTCCTCCAAGAGCACCTCTGG GGGCACAGCGGCCCTGGGCTGCCTGGTCAAGGACTAC TTCCCCGAACCGGTGACGGTGTCGTGGAACTCAGGCGC CCTGACCAGCGGCGTGCACACCTTCCCGGCTGTCCTAC AGTCCTCAGGACTCTACTCCCTCAGCAGCGTGGTGACC GTGCCCTCCAGCAGCTTGGGCACCCAGACCTACATCTG CAACGTGAATCACAAGCCCAGCAACACCAAGGTGGAC AAGAAAGTTGAGCCCAAATCTTGTGACAAAACTCACA CATGCCCACCGTGCCCAGCACCTGAAGCTGCAGGGGG ACCGTCAGTCTTCCTCTTCCCCCCAAAACCCAAGGACA |

TABLE 70-continued cDNA and amino acid sequences of mature bispecific 2 + 1 anti-4-1BB,
anti-FAP human IgG1 P329GLALA. (Constructs with a-FAP VL fused to
hole and VH fused to knob chain, termed in Table 72 below hole-VL)

| SEQ ID NO: | Description | Sequence |
|---|---|---|
| | | CCCTCATGATCTCCCGGACCCCTGAGGTCACATGCGTG<br>GTGGTGGACGTGAGCCACGAAGACCCTGAGGTCAAGT<br>TCAACTGGTACGTGGACGGCGTGGAGGTGCATAATGC<br>CAAGACAAAGCCGCGGGAGGAGCAGTACAACAGCACG<br>TACCGTGTGGTCAGCGTCCTCACCGTCCTGCACCAGGA<br>CTGGCTGAATGGCAAGGAGTACAAGTGCAAGGTCTCC<br>AACAAAGCCCTCGGCGCCCCCATCGAGAAAACCATCT<br>CCAAAGCCAAAGGGCAGCCCCGAGAACCACAGGTGTA<br>CACCCTGCCCCCCTGCAGAGATGAGCTGACCAAGAAC<br>CAGGTGTCCCTGTGGTGTCTGGTCAAGGGCTTCTACCC<br>CAGCGATATCGCCGTGGAGTGGGAGAGCAACGGCCAG<br>CCTGAGAACAACTACAAGACCACCCCCCCTGTGCTGGA<br>CAGCGACGGCAGCTTCTTCCTGTACTCCAAACTGACCG<br>TGGACAAGAGCCGGTGGCAGCAGGGCAACGTGTTCAG<br>CTGCAGCGTGATGCACGAGGCCCTGCACAACCACTAC<br>ACCCAGAAGTCCCTGAGCCTGAGCCCCGGCGGAGGCG<br>GCGGAAGCGGAGGAGGAGGATCTGGGGGCGGAGGTTC<br>CGGAGGCGGTGGATCTGAGGTGCAGCTGCTCGAAAGC<br>GGCGGAGGACTGGTGCAGCCTGGCGGCAGCCTGAGAC<br>TGTCTTGCGCCGCCAGCGGCTTCACCTTCAGCAGCTAC<br>GCCATGAGCTGGGTCCGCCAGGCCCCTGGCAAGGGAC<br>TGGAATGGGTGTCCGCCATCATCGGCTCTGGCGCCAGC<br>ACCTACTACGCCGACAGCGTGAAGGGCCGGTTCACCAT<br>CAGCCGGGACAACAGCAAGAACACCCTGTACCTGCAG<br>ATGAACAGCCTGCGGGCCGAGGACACCGCCGTGTACT<br>ACTGCGCCAAGGGATGGTTCGGCGGCTTCAACTACTGG<br>GGACAGGGCACCCTGGTCACCGTGTCCAGC |
| 321 | (25G7) VHCH1 Fc hole VL (4B9) (nucleotide sequence, heavy chain 2) | GAGGTGCAGCTGCTGGAATCTGGCGGCGGACTGGTGC<br>AGCCTGGCGGATCTCTGAGACTGAGCTGTGCCGCCAGC<br>GGCTTCACCTTCAGCAGCTACGCCATGAGCTGGGTGCG<br>CCAGGCCCCTGGAAAAGGCCTGGAATGGGTGTCCGCC<br>ATCTCTGGCAGCGGCGGCAGCACCTACTACGCCGATTC<br>TGTGAAGGGCCGGTTCACCATCAGCCGGGACAACAGC<br>AAGAACACCCTGTACCTGCAGATGAACAGCCTGCGGG<br>CCGAGGACACCGCCGTGTACTATTGCGCCAGGGACGA<br>CCCCTGGCCCCCCTTTGATTATTGGGGACAGGGCACCC<br>TCGTGACCGTGTCCAGCGCTAGCACCAAGGGCCCATCG<br>GTCTTCCCCCTGGCACCCTCCTCCAAGAGCACCTCTGG<br>GGGCACAGCGGCCCTGGGCTGCCTGGTCAAGGACTAC<br>TTCCCCGAACCGGTGACGGTGTCGTGGAACTCAGGCGC<br>CCTGACCAGCGGCGTGCACACCTTCCCGGCTGTCCTAC<br>AGTCCTCAGGACTCTACTCCCTCAGCAGCGTGGTGACC<br>GTGCCCTCCAGCAGCTTGGGCACCCAGACCTACATCTG<br>CAACGTGAATCACAAGCCCAGCAACACCAAGGTGGAC<br>AAGAAAGTTGAGCCCAAATCTTGTGACAAAACTCACA<br>CATGCCCACCGTGCCCAGCACCTGAAGCTGCAGGGGG<br>ACCGTCAGTCTTCCTCTTCCCCCCAAAACCCAAGGACA<br>CCCTCATGATCTCCCGGACCCCTGAGGTCACATGCGTG<br>GTGGTGGACGTGAGCCACGAAGACCCTGAGGTCAAGT<br>TCAACTGGTACGTGGACGGCGTGGAGGTGCATAATGC<br>CAAGACAAAGCCGCGGGAGGAGCAGTACAACAGCACG<br>TACCGTGTGGTCAGCGTCCTCACCGTCCTGCACCAGGA<br>CTGGCTGAATGGCAAGGAGTACAAGTGCAAGGTCTCC<br>AACAAAGCCCTCGGCGCCCCCATCGAGAAAACCATCT<br>CCAAAGCCAAAGGGCAGCCCCGAGAACCACAGGTGTG<br>CACCCTGCCCCCATCCCGGGATGAGCTGACCAAGAACC<br>AGGTCAGCCTCTCGTGCGCAGTCAAAGGCTTCTATCCC<br>AGCGACATCGCCGTGGAGTGGGAGAGCAATGGGCAGC<br>CGGAGAACAACTACAAGACCACGCCTCCCGTGCTGGA<br>CTCCGACGGCTCCTTCTTCCTCGTGAGCAAGCTCACCG<br>TGGACAAGAGCAGGTGGCAGCAGGGGAACGTCTTCTC<br>ATGCTCCGTGATGCATGAGGCTCTGCACAACCACTACA<br>CGCAGAAGAGCCTCTCCCTGTCTCCGGGTGGAGGCGGC<br>GGAAGCGGAGGAGGAGGATCCGGCGGCGGAGGTTCCG<br>GAGGCGGAGGATCCGAGATCGTGCTGACCCAGTCTCC<br>CGGCACCCTGTCTCTGAGCCCTGGCGAGAGAGCCACCC<br>TGTCCTGCAGAGCCTCCCAGTCCGTGACCTCCTCCTAC<br>CTCGCCTGGTATCAGCAGAAGCCCGGCCAGGCCCCTCG<br>GCTGCTGATCAACGTGGGCAGTCGGAGAGCCACCGGC<br>ATCCCTGACCGGTTCTCCGGCTCTGGCTCCGGCACCGA<br>CTTCACCCTGACCATCTCCCGGCTGGAACCCGAGGACT |

TABLE 70-continued cDNA and amino acid sequences of mature bispecific 2 + 1 anti-4-1BB,
anti-FAP human IgG1 P329GLALA. (Constructs with a-FAP VL fused to
hole and VH fused to knob chain, termed in Table 72 below hole-VL)

| SEQ ID NO: | Description | Sequence |
|---|---|---|
|  |  | TCGCCGTGTACTACTGCCAGCAGGGCATCATGCTGCCC CCCACCTTTGGCCAGGGCACCAAGGTGGAAATCAAG |
| 265 | (25G7) VLCL-light chain | SSELTQDPAVSVALGQTVRITCQGDSLRSYYASWYQQKP GQAPVLVIYGKNNRPSGIPDRFSGSSSGNTASLTITGAQAE DEADYYCNSLDRRGMWVFGGGTKLTVLGQPKAAPSVTL FPPSSEELQANKATLVCLISDFYPGAVTVAWKADSSPVKA GVETTTPSKQSNNKYAASSYLSLTPEQWKSHRSYSCQVT HEGSTVEKTVAPTECS |
| 322 | (25G7) VHCH1 Fc knob VH (4B9) (heavy chain 1) | EVQLLESGGGLVQPGGSLRLSCAASGFTFSSYAMSWVRQ APGKGLEWVSAISGSGGSTYYADSVKGRFTISRDNSKNTL YLQMNSLRAEDTAVYYCARDDPWPPFDYWGQGTLVTV SSASTKGPSVFPLAPSSKSTSGGTAALGCLVKDYFPEPVT VSWNSGALTSGVHTFPAVLQSSGLYSLSSVVTVPSSSLGT QTYICNVNHKPSNTKVDKKVEPKSCDKTHTCPPCPAPEA AGGPSVFLFPPKPKDTLMISRTPEVTCVVVDVSHEDPEVK FNWYVDGVEVHNAKTKPREEQYNSTYRVVSVLTVLHQD WLNGKEYKCKVSNKALGAPIEKTISKAKGQPREPQVYTL PPCRDELTKNQVSLWCLVKGFYPSDIAVEWESNGQPENN YKTTPPVLDSDGSFFLYSKLTVDKSRWQQGNVFSCSVMH EALHNHYTQKSLSLSPGGGGSGGGGSGGGGSGGGGSE VQLLESGGGLVQPGGSLRLSCAASGFTFSSYAMSWVRQA PGKGLEWVSAIIGSGASTYYADSVKGRFTISRDNSKNTLY LQMNSLRAEDTAVYYCAKGWFGGFNYWGQGTLVTVSS |
| 323 | (25G7) VHCH1 Fc hole VL (4B9) (heavy chain 2) | EVQLLESGGGLVQPGGSLRLSCAASGFTFSSYAMSWVRQ APGKGLEWVSAISGSGGSTYYADSVKGRFTISRDNSKNTL YLQMNSLRAEDTAVYYCARDDPWPPFDYWGQGTLVTV SSASTKGPSVFPLAPSSKSTSGGTAALGCLVKDYFPEPVT VSWNSGALTSGVHTFPAVLQSSGLYSLSSVVTVPSSSLGT QTYICNVNHKPSNTKVDKKVEPKSCDKTHTCPPCPAPEA AGGPSVFLFPPKPKDTLMISRTPEVTCVVVDVSHEDPEVK FNWYVDGVEVHNAKTKPREEQYNSTYRVVSVLTVLHQD WLNGKEYKCKVSNKALGAPIEKTISKAKGQPREPQVCTL PPSRDELTKNQVSLSCAVKGFYPSDIAVEWESNGQPENN YKTTPPVLDSDGSFFLVSKLTVDKSRWQQGNVFSCSVMH EALHNHYTQKSLSLSPGGGGSGGGGSGGGGSGGGGSEI VLTQSPGTLSLSPGERATLSCRASQSVTSSYLAWYQQKPG QAPRLLINVGSRRATGIPDRFSGSGSGTDFTLTISRLEPEDF AVYYCQQGIMLPPTFGQGTKVEIK |
| 267 | (11D5) VLCL-light chain (nucleotide sequence) | GACATCCAGATGACCCAGTCTCCTTCCACCCTGTCTGC ATCTGTAGGAGACCGTGTCACCATCACTTGCCGTGCCA GTCAGAGTATTAGTAGCTGGTTGGCCTGGTATCAGCAG AAACCAGGGAAAGCCCCTAAGCTCCTGATCTATGATGC CTCCAGTTTGGAAAGTGGGGTCCCATCACGTTTCAGCG GCAGTGGATCCGGGACAGAATTCACTCTCACCATCAGC AGCTTGCAGCCTGATGATTTTGCAACTTATTACTGCCA ACAGCTTAATTCGTATCCTCAGACGTTTGGCCAGGGCA CCAAAGTCGAGATCAAGCGTACGGTGGCTGCACCATCT GTCTTCATCTTCCCGCCATCTGATGAGCAGTTGAAATC TGGAACTGCCTCTGTTGTGTGCCTGCTGAATAACTTCT ATCCCAGAGAGGCCAAAGTACAGTGGAAGGTGGATAA CGCCCTCCAATCGGGTAACTCCCAGGAGAGTGTCACAG AGCAGGACAGCAAGGACAGCACCTACAGCCTCAGCAG CACCCTGACGCTGAGCAAAGCAGACTACGAGAAACAC AAAGTCTACGCCTGCGAAGTCACCCATCAGGGCCTGA GCTCGCCCGTCACAAAGAGCTTCAACAGGGGAGAGTG T |
| 324 | (11D5) VHCH1 Fc knob VH (4B9) (nucleotide sequence, heavy chain 1) | CAGGTGCAGCTGGTGCAGTCTGGCGCCGAAGTGAAGA AACCCGGCAGCAGCGTGAAGGTGTCCTGCAAGGCTTC CGGCGGCACCTTCAGCAGCTACGCCATTCTTGGGTGC GCCAGGCCCCTGGACAGGGCCTGGAATGGATGGGCGG CATCATCCCCATCTTCGGCACCGCCAACTACGCCCAGA AATTCCAGGGCAGAGTGACCATCACCGCCGACAAGAG CACCAGCACCGCCTACATGGAACTGAGCAGCCTGCGG AGCGAGGACACCGCCGTGTACTACTGTGCCAGAAGCA CCCTGATCTACGCTACTTCGACTACTGGGGCCAGGGC ACCACCGTGACCGTGTCTAGCGCTAGCACCAAGGGCCC ATCGGTCTTCCCCCTGGCACCCTCCTCCAAGAGCACCT CTGGGGGCACAGCGGCCCTGGGCTGCCTGGTCAAGGA |

TABLE 70-continued cDNA and amino acid sequences of mature bispecific 2 + 1 anti-4-1BB, anti-FAP human IgG1 P329GLALA. (Constructs with a-FAP VL fused to hole and VH fused to knob chain, termed in Table 72 below hole-VL)

| SEQ ID NO: | Description | Sequence |
|---|---|---|
| | | CTACTTCCCCGAACCGGTGACGGTGTCGTGGAACTCAG<br>GCGCCCTGACCAGCGGCGTGCACACCTTCCCGGCTGTC<br>CTACAGTCCTCAGGACTCTACTCCCTCAGCAGCGTGGT<br>GACCGTGCCCTCCAGCAGCTTGGGCACCCAGACCTACA<br>TCTGCAACGTGAATCACAAGCCCAGCAACACCAAGGT<br>GGACAAGAAAGTTGAGCCCAAATCTTGTGACAAAACT<br>CACACATGCCCACCGTGCCCAGCACCTGAAGCTGCAG<br>GGGGACCGTCAGTCTTCCTCTTCCCCCCAAAACCCAAG<br>GACACCCTCATGATCTCCCGGACCCCTGAGGTCACATG<br>CGTGGTGGTGGACGTGAGCCACGAAGACCCTGAGGTC<br>AAGTTCAACTGGTACGTGGACGGCGTGGAGGTGCATA<br>ATGCCAAGACAAAGCCGCGGGAGGAGCAGTACAACAG<br>CACGTACCGTGTGGTCAGCGTCCTCACCGTCCTGCACC<br>AGGACTGGCTGAATGGCAAGGAGTACAAGTGCAAGGT<br>CTCCAACAAAGCCCTCGGCGCCCCCATCGAGAAAACC<br>ATCTCCAAAGCCAAAGGGCAGCCCCGAGAACCACAGG<br>TGTACACCCTGCCCCCTGCAGAGATGAGCTGACCAAG<br>AACCAGGTGTCCCTGTGGTGTCTGGTCAAGGGCTTCTA<br>CCCCAGCGATATCGCCGTGGAGTGGGAGAGCAACGGC<br>CAGCCTGAGAACAACTACAAGACCACCCCCCCTGTGCT<br>GGACAGCGACGGCAGCTTCTTCCTGTACTCCAAACTGA<br>CCGTGGACAAGAGCCGGTGGCAGCAGGGCAACGTGTT<br>CAGCTGCAGCGTGATGCACGAGGCCCTGCACAACCAC<br>TACACCCAGAAGTCCCTGAGCCTGAGCCCCGGCGGAG<br>GCGGCGGAAGCGGAGGAGGAGGATCTGGGGGCGGAG<br>GTTCCGGAGGCGGTGGATCTGAGGTGCAGCTGCTCGA<br>AAGCGGCGGAGGACTGGTGCAGCCTGGCGGCAGCCTG<br>AGACTGTCTTGCGCCGCCAGCGGCTTCACCTTCAGCAG<br>CTACGCCATGAGCTGGGTCCGCCAGGCCCCTGGCAAG<br>GGACTGGAATGGGTGTCCGCCATCATCGGCTCTGGCGC<br>CAGCACCTACTACGCCGACAGCGTGAAGGGCCGGTTC<br>ACCATCAGCCGGGACAACAGCAAGAACACCCTGTACC<br>TGCAGATGAACAGCCTGCGGGCCGAGGACACCGCCGT<br>GTACTACTGCGCCAAGGGATGGTTCGGCGGCTTCAACT<br>ACTGGGGACAGGGCACCCTGGTCACCGTGTCCAGC |
| 325 | (11D5) VHCH1 Fc hole VL (4B9) (nucleotide sequence, heavy chain 2) | CAGGTGCAGCTGGTGCAGTCTGGCGCCGAAGTGAAGA<br>AACCCGGCAGCAGCGTGAAGGTGTCCTGCAAGGCTTC<br>CGGCGGCACCTTCAGCAGCTACGCCATTTCTTGGGTGC<br>GCCAGGCCCCTGGACAGGGCCTGGAATGGATGGGCGG<br>CATCATCCCCATCTTCGGCACCGCCAACTACGCCCAGA<br>AATTCCAGGGCAGAGTGACCATCACCGCCGACAAGAG<br>CACCAGCACCGCCTACATGGAACTGAGCAGCCTGCGG<br>AGCGAGGACACCGCCGTGTACTACTGTGCCAGAAGCA<br>CCCTGATCTACGGCTACTTCGACTACTGGGGCCAGGGC<br>ACCACCGTGACCGTGTCTAGCGCTAGCACCAAGGGCCC<br>ATCGGTCTTCCCCCTGGCACCCTCCTCCAAGAGCACCT<br>CTGGGGGCACAGCGGCCCTGGGCTGCCTGGTCAAGGA<br>CTACTTCCCCGAACCGGTGACGGTGTCGTGGAACTCAG<br>GCGCCCTGACCAGCGGCGTGCACACCTTCCCGGCTGTC<br>CTACAGTCCTCAGGACTCTACTCCCTCAGCAGCGTGGT<br>GACCGTGCCCTCCAGCAGCTTGGGCACCCAGACCTACA<br>TCTGCAACGTGAATCACAAGCCCAGCAACACCAAGGT<br>GGACAAGAAAGTTGAGCCCAAATCTTGTGACAAAACT<br>CACACATGCCCACCGTGCCCAGCACCTGAAGCTGCAG<br>GGGGACCGTCAGTCTTCCTCTTCCCCCCAAAACCCAAG<br>GACACCCTCATGATCTCCCGGACCCCTGAGGTCACATG<br>CGTGGTGGTGGACGTGAGCCACGAAGACCCTGAGGTC<br>AAGTTCAACTGGTACGTGGACGGCGTGGAGGTGCATA<br>ATGCCAAGACAAAGCCGCGGGAGGAGCAGTACAACAG<br>CACGTACCGTGTGGTCAGCGTCCTCACCGTCCTGCACC<br>AGGACTGGCTGAATGGCAAGGAGTACAAGTGCAAGGT<br>CTCCAACAAAGCCCTCGGCGCCCCCATCGAGAAAACC<br>ATCTCCAAAGCCAAAGGGCAGCCCCGAGAACCACAGG<br>TGTGCACCCTGCCCCCATCCCGGGATGAGCTGACCAAG<br>AACCAGGTCAGCCTCTCGTGCGCAGTCAAAGGCTTCTA<br>TCCCAGCGACATCGCCGTGGAGTGGGAGAGCAATGGG<br>CAGCCGGAGAACAACTACAAGACCACGCCTCCCGTGC<br>TGGACTCCGACGGCTCCTTCTTCCTCGTGAGCAAGCTC<br>ACCGTGGACAAGAGCAGGTGGCAGCAGGGGAACGTCT<br>TCTCATGCTCCGTGATGCATGAGGCTCTGCACAACCAC<br>TACACGCAGAAGAGCCTCTCCCTGTCTCCGGGTGGAGG<br>CGGCGGAAGCGGAGGAGGAGGATCCGGCGGCGGAGG |

TABLE 70-continued cDNA and amino acid sequences of mature bispecific 2 + 1 anti-4-1BB, anti-FAP human IgG1 P329GLALA. (Constructs with a-FAP VL fused to hole and VH fused to knob chain, termed in Table 72 below hole-VL)

| SEQ ID NO: | Description | Sequence |
|---|---|---|
| | | TTCCGGAGGCGGAGGATCCGAGATCGTGCTGACCCAG TCTCCCGGCACCCTGTCTCTGAGCCCTGGCGAGAGAGC CACCCTGTCCTGCAGAGCCTCCCAGTCCGTGACCTCCT CCTACCTCGCCTGGTATCAGCAGAAGCCCGGCCAGGCC CCTCGGCTGCTGATCAACGTGGGCAGTCGGAGAGCCA CCGGCATCCCTGACCGGTTCTCCGGCTCTGGCTCCGGC ACCGACTTCACCCTGACCATCTCCCGGCTGGAACCCGA GGACTTCGCCGTGTACTACTGCCAGCAGGGCATCATGC TGCCCCCCACCTTTGGCCAGGGCACCAAGGTGGAAATC AAG |
| 269 | (11D5) VLCL-light chain | DIQMTQSPSTLSASVGDRVTITCRASQSISSWLAWYQQKP GKAPKLLIYDASSLESGVPSRFSGSGSGTEFTLTISSLQPDD FATYYCQQLNSYPQTFGQGTKVEIKRTVAAPSVFIFPPSD EQLKSGTASVVCLLNNFYPREAKVQWKVDNALQSGNSQ ESVTEQDSKDSTYSLSSTLTLSKADYEKHKVYACEVTHQ GLSSPVTKSFNRGEC |
| 326 | (11D5) VHCH1 Fc knob VH (4B9) (heavy chain 1) | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCARSTLIYGYFDYWGQGTTVTVS SASTKGPSVFPLAPSSKSTSGGTAALGCLVKDYFPEPVTV SWNSGALTSGVHTFPAVLQSSGLYSLSSVVTVPSSSLGTQ TYICNVNHKPSNTKVDKKVEPKSCDKTHTCPPCPAPEAA GGPSVFLFPPKPKDTLMISRTPEVTCVVVDVSHEDPEVKF NWYVDGVEVHNAKTKPREEQYNSTYRVVSVLTVLHQD WLNGKEYKCKVSNKALGAPIEKTISKAKGQPREPQVYTL PPCRDELTKNQVSLWCLVKGFYPSDIAVEWESNGQPENN YKTTPPVLDSDGSFFLYSKLTVDKSRWQQGNVFSCSVMH EALHNHYTQKSLSLSPGGGGSGGGGSGGGGSGGGGSE VQLLESGGGLVQPGGSLRLSCAASGFTFSSYAMSWVRQA PGKGLEWVSAIIGSGASTYYADSVKGRFTISRDNSKNTLY LQMNSLRAEDTAVYYCAKGWFGGFNYWGQGTLVTVSS |
| 327 | (11D5) VHCH1 Fc hole VL (4B9) (heavy chain 2) | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCARSTLIYGYFDYWGQGTTVTVS SASTKGPSVFPLAPSSKSTSGGTAALGCLVKDYFPEPVTV SWNSGALTSGVHTFPAVLQSSGLYSLSSVVTVPSSSLGTQ TYICNVNHKPSNTKVDKKVEPKSCDKTHTCPPCPAPEAA GGPSVFLFPPKPKDTLMISRTPEVTCVVVDVSHEDPEVKF NWYVDGVEVHNAKTKPREEQYNSTYRVVSVLTVLHQD WLNGKEYKCKVSNKALGAPIEKTISKAKGQPREPQVCTL PPSRDELTKNQVSLSCAVKGFYPSDIAVEWESNGQPENN YKTTPPVLDSDGSFFLVSKLTVDKSRWQQGNVFSCSVMH EALHNHYTQKSLSLSPGGGGSGGGGSGGGGSGGGGSEI VLTQSPGTLSLSPGERATLSCRASQSVTSSYLAWYQQKPG QAPRLLINVGSRRATGIPDRFSGSGSGTDFTLTISRLEPEDF AVYYCQQGIMLPPTFGQGTKVEIK |
| 271 | (9B11) VLCL-light chain (nucleotide sequence) | GACATCCAGATGACCCAGTCTCCTTCCACCCTGTCTGC ATCTGTAGGAGACCGTGTCACCATCACTTGCCGTGCCA GTCAGAGTATTAGTAGCTGGTTGGCCTGGTATCAGCAG AAACCAGGGAAAGCCCCTAAGCTCCTGATCTATGATGC CTCCAGTTTGGAAAGTGGGGTCCCATCACGTTTCAGCG GCAGTGGATCCGGGACAGAATTCACTCTCACCATCAGC AGCTTGCAGCCTGATGATTTTGCAACTTATTACTGCCA ACAGGTTAATTCTTATCCGCAGACGTTTGGCCAGGGCA CCAAAGTCGAGATCAAGCGTACGGTGGCTGCACCATCT GTCTTCATCTTCCCGCCATCTGATGAGCAGTTGAAATC TGGAACTGCCTCTGTTGTGTGCCTGCTGAATAACTTCT ATCCCAGAGAGGCCAAAGTACAGTGGAAGGTGGATAA CGCCCTCCAATCGGGTAACTCCCAGGAGAGTGTCACAG AGCAGGACAGCAAGGACAGCACCTACAGCCTCAGCAG CACCCTGACGCTGAGCAAAGCAGACTACGAGAAACAC AAAGTCTACGCCTGCGAAGTCACCCATCAGGGCCTGA GCTCGCCCGTCACAAAGAGCTTCAACAGGGGAGAGTG T |
| 328 | (9B11) VHCH1 Fc knob VH (4B9) (nucleotide sequence, heavy chain 1) | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTCGAGTGGATGGGAGG |

TABLE 70-continued cDNA and amino acid sequences of mature bispecific 2 + 1 anti-4-1BB, anti-FAP human IgG1 P329GLALA. (Constructs with a-FAP VL fused to hole and VH fused to knob chain, termed in Table 72 below hole-VL)

| SEQ ID NO: | Description | Sequence |
|---|---|---|
| | | GATCATCCCTATCTTTGGTACAGCAAACTACGCACAGA<br>AGTTCCAGGGCAGGGTCACCATTACTGCAGACAAATCC<br>ACGAGCACAGCCTACATGGAGCTGAGCAGCCTGAGAT<br>CTGAGGACACCGCCGTGTATTACTGTGCGAGATCTTCT<br>GGTGCTTACCCGGGTTACTTCGACTACTGGGGCCAAGG<br>GACCACCGTGACCGTCTCCTCAGCTAGCACCAAGGGCC<br>CATCGGTCTTCCCCCTGGCACCCTCCTCCAAGAGCACC<br>TCTGGGGGCACAGCGGCCCTGGGCTGCCTGGTCAAGG<br>ACTACTTCCCCGAACCGGTGACGGTGTCGTGGAACTCA<br>GGCGCCCTGACCAGCGGCGTGCACACCTTCCCGGCTGT<br>CCTACAGTCCTCAGGACTCTACTCCCTCAGCAGCGTGG<br>TGACCGTGCCCTCCAGCAGCTTGGGCACCCAGACCTAC<br>ATCTGCAACGTGAATCACAAGCCCAGCAACACCAAGG<br>TGGACAAGAAAGTTGAGCCCAAATCTTGTGACAAAAC<br>TCACACATGCCCACCGTGCCCAGCACCTGAAGCTGCAG<br>GGGGACCGTCAGTCTTCCTCTTCCCCCCAAAACCCAAG<br>GACACCCTCATGATCTCCCGGACCCCTGAGGTCACATG<br>CGTGGTGGTGGACGTGAGCCACGAAGACCCTGAGGTC<br>AAGTTCAACTGGTACGTGGACGGCGTGGAGGTGCATA<br>ATGCCAAGACAAAGCCGCGGGAGGAGCAGTACAACAG<br>CACGTACCGTGTGGTCAGCGTCCTCACCGTCCTGCACC<br>AGGACTGGCTGAATGGCAAGGAGTACAAGTGCAAGGT<br>CTCCAACAAAGCCCTCGGCGCCCCCATCGAGAAAACC<br>ATCTCCAAAGCCAAAGGGCAGCCCCGAGAACCACAGG<br>TGTACACCCTGCCCCCTGCAGAGATGAGCTGACCAAG<br>AACCAGGTGTCCCTGTGGTGTCTGGTCAAGGGCTTCTA<br>CCCCAGCGATATCGCCGTGGAGTGGGAGAGCAACGGC<br>CAGCCTGAGAACAACTACAAGACCACCCCCCCTGTGCT<br>GGACAGCGACGGCAGCTTCTTCCTGTACTCCAAACTGA<br>CCGTGGACAAGAGCCGGTGGCAGCAGGGCAACGTGTT<br>CAGCTGCAGCGTGATGCACGAGGCCCTGCACAACCAC<br>TACACCCAGAAGTCCCTGAGCCTGAGCCCCGGCGGAG<br>GCGGCGGAAGCGGAGGAGGAGGATCTGGGGGCGGAG<br>GTTCCGGAGGCGGTGGATCTGAGGTGCAGCTGCTCGA<br>AAGCGGCGGAGGACTGGTGCAGCCTGGCGGCAGCCTG<br>AGACTGTCTTGCGCCGCCAGCGGCTTCACCTTCAGCAG<br>CTACGCCATGAGCTGGGTCCGCCAGGCCCCTGGCAAG<br>GGACTGGAATGGGTGTCCGCCATCATCGGCTCTGGCGC<br>CAGCACCTACTACGCCGACAGCGTGAAGGGCCGGTTC<br>ACCATCAGCCGGGACAACAGCAAGAACACCCTGTACC<br>TGCAGATGAACAGCCTGCGGGCCGAGGACACCGCCGT<br>GTACTACTGCGCCAAGGGATGGTTCGGCGGCTTCAACT<br>ACTGGGGACAGGGCACCCTGGTCACCGTGTCCAGC |
| 329 | (9B11) VHCH1 Fc hole VL (4B9) (nucleotide sequence, heavy chain 2) | CAGGTGCAATTGGTGCAGTCTGGGGCTGAGGTGAAGA<br>AGCCTGGGTCCTCGGTGAAGGTCTCCTGCAAGGCCTCC<br>GGAGGCACATTCAGCAGCTACGCTATAAGCTGGGTGC<br>GACAGGCCCCTGGACAAGGGCTCGAGTGGATGGGAGG<br>GATCATCCCTATCTTTGGTACAGCAAACTACGCACAGA<br>AGTTCCAGGGCAGGGTCACCATTACTGCAGACAAATCC<br>ACGAGCACAGCCTACATGGAGCTGAGCAGCCTGAGAT<br>CTGAGGACACCGCCGTGTATTACTGTGCGAGATCTTCT<br>GGTGCTTACCCGGGTTACTTCGACTACTGGGGCCAAGG<br>GACCACCGTGACCGTCTCCTCAGCTAGCACCAAGGGCC<br>CATCGGTCTTCCCCCTGGCACCCTCCTCCAAGAGCACC<br>TCTGGGGGCACAGCGGCCCTGGGCTGCCTGGTCAAGG<br>ACTACTTCCCCGAACCGGTGACGGTGTCGTGGAACTCA<br>GGCGCCCTGACCAGCGGCGTGCACACCTTCCCGGCTGT<br>CCTACAGTCCTCAGGACTCTACTCCCTCAGCAGCGTGG<br>TGACCGTGCCCTCCAGCAGCTTGGGCACCCAGACCTAC<br>ATCTGCAACGTGAATCACAAGCCCAGCAACACCAAGG<br>TGGACAAGAAAGTTGAGCCCAAATCTTGTGACAAAAC<br>TCACACATGCCCACCGTGCCCAGCACCTGAAGCTGCAG<br>GGGGACCGTCAGTCTTCCTCTTCCCCCCAAAACCCAAG<br>GACACCCTCATGATCTCCCGGACCCCTGAGGTCACATG<br>CGTGGTGGTGGACGTGAGCCACGAAGACCCTGAGGTC<br>AAGTTCAACTGGTACGTGGACGGCGTGGAGGTGCATA<br>ATGCCAAGACAAAGCCGCGGGAGGAGCAGTACAACAG<br>CACGTACCGTGTGGTCAGCGTCCTCACCGTCCTGCACC<br>AGGACTGGCTGAATGGCAAGGAGTACAAGTGCAAGGT<br>CTCCAACAAAGCCCTCGGCGCCCCCATCGAGAAAACC<br>ATCTCCAAAGCCAAAGGGCAGCCCCGAGAACCACAGG<br>TGTGCACCCTGCCCCCATCCCGGGATGAGCTGACCAAG |

TABLE 70-continued cDNA and amino acid sequences of mature bispecific 2 + 1 anti-4-1BB, anti-FAP human IgG1 P329GLALA. (Constructs with a-FAP VL fused to hole and VH fused to knob chain, termed in Table 72 below hole-VL)

| SEQ ID NO: | Description | Sequence |
|---|---|---|
| | | AACCAGGTCAGCCTCTCGTGCGCAGTCAAAGGCTTCTA TCCCAGCGACATCGCCGTGGAGTGGGAGAGCAATGGG CAGCCGGAGAACAACTACAAGACCACGCCTCCCGTGC TGGACTCCGACGGCTCCTTCTTCCTCGTGAGCAAGCTC ACCGTGGACAAGAGCAGGTGGCAGCAGGGGAACGTCT TCTCATGCTCCGTGATGCATGAGGCTCTGCACAACCAC TACACGCAGAAGAGCCTCTCCCTGTCTCCGGGTGGAGG CGGCGGAAGCGGAGGAGGAGGATCCGGCGGCGGAGG TTCCGGAGGCGGAGGATCCGAGATCGTGCTGACCCAG TCTCCCGGCACCCTGTCTCTGAGCCCTGGCGAGAGAGC CACCCTGTCCTGCAGAGCCTCCCAGTCCGTGACCTCCT CCTACCTCGCCTGGTATCAGCAGAAGCCCGGCCAGGCC CCTCGGCTGCTGATCAACGTGGGCAGTCGGAGAGCCA CCGGCATCCCTGACCGGTTCTCCGGCTCTGGCTCCGGC ACCGACTTCACCCTGACCATCTCCCGGCTGGAACCCGA GGACTTCGCCGTGTACTACTGCCAGCAGGGCATCATGC TGCCCCCCACCTTTGGCCAGGGCACCAAGGTGGAAATC AAG |
| 273 | (9B11) VLCL-light chain | DIQMTQSPSTLSASVGDRVTITCRASQSISSWLAWYQQKP GKAPKLLIYDASSLESGVPSRFSGSGSGTEFTLTISSLQPDD FATYYCQQVNSYPQTFGQGTKVEIKRTVAAPSVFIFPPSD EQLKSGTASVVCLLNNFYPREAKVQWKVDNALQSGNSQ ESVTEQDSKDSTYSLSSTLTLSKADYEKHKVYACEVTHQ GLSSPVTKSFNRGEC |
| 330 | (9B11) VHCH1 Fc knob VH (4B9) (heavy chain 1) | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCARSSGAYPGYFDYWGQGTTVT VSSASTKGPSVFPLAPSSKSTSGGTAALGCLVKDYFPEPV TVSWNSGALTSGVHTFPAVLQSSGLYSLSSVVTVPSSSLG TQTYICNVNHKPSNTKVDKKVEPKSCDKTHTCPPCPAPE AAGGPSVFLFPPKPKDTLMISRTPEVTCVVVDVSHEDPEV KFNWYVDGVEVHNAKTKPREEQYNSTYRVVSVLTVLHQ DWLNGKEYKCKVSNKALGAPIEKTISKAKGQPREPQVYT LPPCRDELTKNQVSLWCLVKGFYPSDIAVEWESNGQPEN NYKTTPPVLDSDGSFFLYSKLTVDKSRWQQGNVFSCSVM HEALHNHYTQKSLSLSPGGGGGSGGGGSGGGGSGGGGS EVQLLESGGGLVQPGGSLRLSCAASGFTFSSYAMSWVRQ APGKGLEWVSAIIGSGASTYYADSVKGRFTISRDNSKNTL YLQMNSLRAEDTAVYYCAKGWFGGFNYWGQGTLVTVS S |
| 331 | (9B11) VHCH1 Fc hole VL (4B9) (heavy chain 2) | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCARSSGAYPGYFDYWGQGTTVT VSSASTKGPSVFPLAPSSKSTSGGTAALGCLVKDYFPEPV TVSWNSGALTSGVHTFPAVLQSSGLYSLSSVVTVPSSSLG TQTYICNVNHKPSNTKVDKKVEPKSCDKTHTCPPCPAPE AAGGPSVFLFPPKPKDTLMISRTPEVTCVVVDVSHEDPEV KFNWYVDGVEVHNAKTKPREEQYNSTYRVVSVLTVLHQ DWLNGKEYKCKVSNKALGAPIEKTISKAKGQPREPQVCT LPPSRDELTKNQVSLSCAVKGFYPSDIAVEWESNGQPENN YKTTPPVLDSDGSFFLVSKLTVDKSRWQQGNVFSCSVMH EALHNHYTQKSLSLSPGGGGGSGGGGSGGGGSGGGGSEI VLTQSPGTLSLSPGERATLSCRASQSVTSSYLAWYQQKPG QAPRLLINVGSRRATGIPDRFSGSGSGTDFTLTISRLEPEDF AVYYCQQGIMLPPTFGQGTKVEIK |

The base pair and amino acid sequences for 2+1 anti-4-1BB, anti-FAP constructs with a-FAP VL fused to knob and VH fused to hole chain can be found respectively in Table 71.

TABLE 71 cDNA and amino acid sequences of mature bispecific 2 + 1 anti-4-1BB, anti-FAP human IgG1 P329GLALA. (constructs with a-FAP VH fused to hole and VL fused to knob chain, termed below hole-VH)

| SEQ ID NO: | Description | Sequence |
|---|---|---|
| 259 | (12B3) VLCL-light chain (nucleotide sequence) | see Table 70 |
| 332 | (12B3) VHCH1 Fc knob VL (4B9) (nucleotide sequence of HC 1) | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTGGAGTGGATGGGAGG GATCATCCCTATCTTTGGTACAGCAAACTACGCACAGA AGTTCCAGGGCAGGGTCACCATTACTGCAGACAAATCC ACGAGCACAGCCTACATGGAGCTGAGCAGCCTGAGAT CTGAGGACACCGCCGTGTATTACTGTGCGAGATCTGAA TTCCGTTTCTACGCTGACTTCGACTACTGGGGCCAAGG GACCACCGTGACCGTCTCGAGTGCTAGCACCAAGGGC CCATCGGTCTTCCCCCTGGCACCCTCCTCCAAGAGCAC CTCTGGGGGCACAGCGGCCCTGGGCTGCCTGGTCAAG GACTACTTCCCCGAACCGGTGACGGTGTCGTGGAACTC AGGCGCCCTGACCAGCGGCGTGCACACCTTCCCGGCTG TCCTACAGTCCTCAGGACTCTACTCCCTCAGCAGCGTG GTGACCGTGCCCTCCAGCAGCTTGGGCACCCAGACCTA CATCTGCAACGTGAATCACAAGCCCAGCAACACCAAG GTGGACAAGAAAGTTGAGCCCAAATCTTGTGACAAAA CTCACACATGCCCACCGTGCCCAGCACCTGAAGCTGCA GGGGGACCGTCAGTCTTCCTCTTCCCCCCAAAACCCAA GGACACCCTCATGATCTCCCGGACCCCTGAGGTCACAT GCGTGGTGGTGGACGTGAGCCACGAAGACCCTGAGGT CAAGTTCAACTGGTACGTGGACGGCGTGGAGGTGCAT AATGCCAAGACAAAGCCGCGGGAGGAGCAGTACAACA GCACGTACCGTGTGGTCAGCGTCCTCACCGTCCTGCAC CAGGACTGGCTGAATGGCAAGGAGTACAAGTGCAAGG TCTCCAACAAAGCCCTCGGCGCCCCCATCGAGAAAACC ATCTCCAAAGCCAAAGGGCAGCCCCGAGAACCACAGG TGTACACCCTGCCCCCCTGCAGAGATGAGCTGACCAAG AACCAGGTGTCCCTGTGGTGTCTGGTCAAGGGCTTCTA CCCCAGCGATATCGCCGTGGAGTGGGAGAGCAACGGC CAGCCTGAGAACAACTACAAGACCACCCCCCCTGTGCT GGACAGCGACGGCAGCTTCTTCCTGTACTCCAAACTGA CCGTGGACAAGAGCCGGTGGCAGCAGGGCAACGTGTT CAGCTGCAGCGTGATGCACGAGGCCCTGCACAACCAC TACACCCAGAAGTCCCTGAGCCTGAGCCCCGGCGGAG GCGGCGGAAGCGGAGGAGGAGGATCTGGGGGCGGAG GTTCCGGAGGCGGTGGATCTGAGATCGTGCTGACCCAG TCTCCCGGCACCCTGTCTCTGAGCCCTGGCGAGAGAGC CACCCTGTCCTGCAGAGCCTCCCAGTCCGTGACCTCCT CCTACCTCGCCTGGTATCAGCAGAAGCCCGGCCAGGCC CCTCGGCTGCTGATCAACGTGGGCAGTCGGAGAGCCA CCGGCATCCCTGACCGGTTCTCCGGCTCTGGCTCCGGC ACCGACTTCACCCTGACCATCTCCCGGCTGGAACCCGA GGACTTCGCCGTGTACTACTGCCAGCAGGGCATCATGC TGCCCCCCACCTTTGGCCAGGGCACCAAGGTGGAAATC AAG |
| 333 | (12B3) VHCH1 Fc hole VH (4B9) (nucleotide sequence of HC2) | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTGGAGTGGATGGGAGG GATCATCCCTATCTTTGGTACAGCAAACTACGCACAGA AGTTCCAGGGCAGGGTCACCATTACTGCAGACAAATCC ACGAGCACAGCCTACATGGAGCTGAGCAGCCTGAGAT CTGAGGACACCGCCGTGTATTACTGTGCGAGATCTGAA TTCCGTTTCTACGCTGACTTCGACTACTGGGGCCAAGG GACCACCGTGACCGTCTCGAGTGCTAGCACCAAGGGC CCATCGGTCTTCCCCCTGGCACCCTCCTCCAAGAGCAC CTCTGGGGGCACAGCGGCCCTGGGCTGCCTGGTCAAG GACTACTTCCCCGAACCGGTGACGGTGTCGTGGAACTC AGGCGCCCTGACCAGCGGCGTGCACACCTTCCCGGCTG TCCTACAGTCCTCAGGACTCTACTCCCTCAGCAGCGTG GTGACCGTGCCCTCCAGCAGCTTGGGCACCCAGACCTA CATCTGCAACGTGAATCACAAGCCCAGCAACACCAAG GTGGACAAGAAAGTTGAGCCCAAATCTTGTGACAAAA CTCACACATGCCCACCGTGCCCAGCACCTGAAGCTGCA GGGGGACCGTCAGTCTTCCTCTTCCCCCCAAAACCCAA GGACACCCTCATGATCTCCCGGACCCCTGAGGTCACAT |

TABLE 71-continued cDNA and amino acid sequences of mature bispecific 2 + 1 anti-4-1BB, anti-FAP human IgG1 P329GLALA. (constructs with a-FAP VH fused to hole and VL fused to knob chain, termed below hole-VH)

| SEQ ID NO: | Description | Sequence |
|---|---|---|
| | | GCGTGGTGGTGGACGTGAGCCACGAAGACCCTGAGGT CAAGTTCAACTGGTACGTGGACGGCGTGGAGGTGCAT AATGCCAAGACAAAGCCGCGGGAGGAGCAGTACAACA GCACGTACCGTGTGGTCAGCGTCCTCACCGTCCTGCAC CAGGACTGGCTGAATGGCAAGGAGTACAAGTGCAAGG TCTCCAACAAAGCCCTCGGCGCCCCCATCGAGAAAACC ATCTCCAAAGCCAAAGGGCAGCCCCGAGAACCACAGG TGTGCACCCTGCCCCCATCCCGGGATGAGCTGACCAAG AACCAGGTCAGCCTCTCGTGCGCAGTCAAAGGCTTCTA TCCCAGCGACATCGCCGTGGAGTGGGAGAGCAATGGG CAGCCGGAGAACAACTACAAGACCACGCCTCCCGTGC TGGACTCCGACGGCTCCTTCTTCCTCGTGAGCAAGCTC ACCGTGGACAAGAGCAGGTGGCAGCAGGGGAACGTCT TCTCATGCTCCGTGATGCATGAGGCTCTGCACAACCAC TACACGCAGAAGAGCCTCTCCCTGTCTCCGGGTGGAGG CGGCGGAAGCGGAGGAGGAGGATCCGGCGGCGGAGG TTCCGGAGGCGGAGGATCCGAGGTGCAGCTGCTCGAA AGCGGCGGAGGACTGGTGCAGCCTGGCGGCAGCCTGA GACTGTCTTGCGCCGCCAGCGGCTTCACCTTCAGCAGC TACGCCATGAGCTGGGTCCGCCAGGCCCCTGGCAAGG GACTGGAATGGGTGTCCGCCATCATCGGCTCTGGCGCC AGCACCTACTACGCCGACAGCGTGAAGGGCCGGTTCA CCATCAGCCGGGACAACAGCAAGAACACCCTGTACCT GCAGATGAACAGCCTGCGGGCCGAGGACACCGCCGTG TACTACTGCGCCAAGGGATGGTTCGGCGGCTTCAACTA CTGGGGACAGGGCACCCTGGTCACCGTGTCCAGC |
| 261 | (12B3) VLCL-light chain | see Table 70 |
| 334 | (12B3) VHCH1 Fc knob VL (4B9) (heavy chain 1) | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCARSEFRFYADFDYWGQGTTVT VSSASTKGPSVFPLAPSSKSTSGGTAALGCLVKDYFPEPV TVSWNSGALTSGVHTFPAVLQSSGLYSLSSVVTVPSSSLG TQTYICNVNHKPSNTKVDKKVEPKSCDKTHTCPPCPAPE AAGGPSVFLFPPKPKDTLMISRTPEVTCVVVDVSHEDPEV KFNWYVDGVEVHNAKTKPREEQYNSTYRVVSVLTVLHQ DWLNGKEYKCKVSNKALGAPIEKTISKAKGQPREPQVYT LPPCRDELTKNQVSLWCLVKGFYPSDIAVEWESNGQPEN NYKTTPPVLDSDGSFFLYSKLTVDKSRWQQGNVFSCSVM HEALHNHYTQKSLSLSPGGGGGSGGGGSGGGGSGGGGS EIVLTQSPGTLSLSPGERATLSCRASQSVTSSYLAWYQQK PGQAPRLLINVGSRRATGIPDRFSGSGSGTDFTLTISRLEPE DFAVYYCQQGIMLPPTFGQGTKVEIK |
| 335 | (12B3) VHCH1 Fc hole VH (4B9) (heavy chain 2) | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCARSEFRFYADFDYWGQGTTVT VSSASTKGPSVFPLAPSSKSTSGGTAALGCLVKDYFPEPV TVSWNSGALTSGVHTFPAVLQSSGLYSLSSVVTVPSSSLG TQTYICNVNHKPSNTKVDKKVEPKSCDKTHTCPPCPAPE AAGGPSVFLFPPKPKDTLMISRTPEVTCVVVDVSHEDPEV KFNWYVDGVEVHNAKTKPREEQYNSTYRVVSVLTVLHQ DWLNGKEYKCKVSNKALGAPIEKTISKAKGQPREPQVCT LPPSRDELTKNQVSLSCAVKGFYPSDIAVEWESNGQPENN YKTTPPVLDSDGSFFLVSKLTVDKSRWQQGNVFSCSVMH EALHNHYTQKSLSLSPGGGGGSGGGGSGGGGSGGGGSE VQLLESGGGLVQPGGSLRLSCAASGFTFSSYAMSWVRQA PGKGLEWVSAIIGSGASTYYADSVKGRFTISRDNSKNTLY LQMNSLRAEDTAVYYCAKGWFGGFNYWGQGTLVTVSS |
| 263 | (25G7) VLCL-light chain (nucleotide sequence) | see Table 70 |
| 336 | (25G7) VHCH1 Fc knob VL (4B9) (nucleotide sequence, heavy chain 1) | GAGGTGCAATTGTTGGAGTCTGGGGGAGGCTTGGTAC AGCCTGGGGGGTCCCTGAGACTCTCCTGTGCAGCCTCC GGATTCACCTTTAGCAGTTATGCCATGAGCTGGGTCCG CCAGGCTCCAGGGAAGGGGCTGGAGTGGGTCTCAGCT ATTAGTGGTAGTGGTGGTAGCACATACTACGCAGACTC CGTGAAGGGCCGGTTCACCATCTCCAGAGACAATTCCA AGAACACGCTGTATCTGCAGATGAACAGCCTGAGAGC |

TABLE 71-continued cDNA and amino acid sequences of mature bispecific 2 + 1 anti-4-1BB, anti-FAP human IgG1 P329GLALA. (constructs with a-FAP VH fused to hole and VL fused to knob chain, termed below hole-VH)

| SEQ ID NO: | Description | Sequence |
|---|---|---|
| | | CGAGGACACGGCCGTATATTACTGTGCGCGTGACGACC<br>CGTGGCCGCCGTTCGACTACTGGGGCCAAGGAACCCTG<br>GTCACCGTCTCGAGTGCTAGCACCAAGGGCCCATCGGT<br>CTTCCCCCTGGCACCCTCCTCCAAGAGCACCTCTGGGG<br>GCACAGCGGCCCTGGGCTGCCTGGTCAAGGACTACTTC<br>CCCGAACCGGTGACGGTGTCGTGGAACTCAGGCGCCCT<br>GACCAGCGGCGTGCACACCTTCCCGGCTGTCCTACAGT<br>CCTCAGGACTCTACTCCCTCAGCAGCGTGGTGACCGTG<br>CCCTCCAGCAGCTTGGGCACCCAGACCTACATCTGCAA<br>CGTGAATCACAAGCCCAGCAACACCAAGGTGGACAAG<br>AAAGTTGAGCCCAAATCTTGTGACAAAACTCACACATG<br>CCCACCGTGCCCAGCACCTGAAGCTGCAGGGGGACCG<br>TCAGTCTTCCTCTTCCCCCCAAAACCCAAGGACACCCT<br>CATGATCTCCCGGACCCCTGAGGTCACATGCGTGGTGG<br>TGGACGTGAGCCACGAAGACCCTGAGGTCAAGTTCAA<br>CTGGTACGTGGACGGCGTGGAGGTGCATAATGCCAAG<br>ACAAAGCCGCGGGAGGAGCAGTACAACAGCACGTACC<br>GTGTGGTCAGCGTCCTCACCGTCCTGCACCAGGACTGG<br>CTGAATGGCAAGGAGTACAAGTGCAAGGTCTCCAACA<br>AAGCCCTCGGCGCCCCCATCGAGAAAACCATCTCCAA<br>AGCCAAAGGGCAGCCCCGAGAACCACAGGTGTACACC<br>CTGCCCCCCTGCAGAGATGAGCTGACCAAGAACCAGG<br>TGTCCCTGTGGTGTCTGGTCAAGGGCTTCTACCCCAGC<br>GATATCGCCGTGGAGTGGGAGAGCAACGGCCAGCCTG<br>AGAACAACTACAAGACCACCCCCCCTGTGCTGGACAG<br>CGACGGCAGCTTCTTCCTGTACTCCAAACTGACCGTGG<br>ACAAGAGCCGGTGGCAGCAGGGCAACGTGTTCAGCTG<br>CAGCGTGATGCACGAGGCCCTGCACAACCACTACACC<br>CAGAAGTCCCTGAGCCTGAGCCCCGGCGGAGGCGGCG<br>GAAGCGGAGGAGGAGGATCTGGGGGCGGAGGTTCCGG<br>AGGCGGTGGATCTGAGATCGTGCTGACCCAGTCTCCCG<br>GCACCCTGTCTCTGAGCCCTGGCGAGAGAGCCACCCTG<br>TCCTGCAGAGCCTCCCAGTCCGTGACCTCCTCCTACCT<br>CGCCTGGTATCAGCAGAAGCCCGGCCAGGCCCCTCGG<br>CTGCTGATCAACGTGGGCAGTCGGAGAGCCACCGGCA<br>TCCCTGACCGGTTCTCCGGCTCTGGCTCCGGCACCGAC<br>TTCACCCTGACCATCTCCCGGCTGGAACCCGAGGACTT<br>CGCCGTGTACTACTGCCAGCAGGGCATCATGCTGCCCC<br>CCACCTTTGGCCAGGGCACCAAGGTGGAAATCAAG |
| 337 | (25G7) VHCH1 Fc hole VH (4B9) (nucleotide sequence, heavy chain 2) | GAGGTGCAATTGTTGGAGTCTGGGGGAGGCTTGGTAC<br>AGCCTGGGGGGTCCCTGAGACTCTCCTGTGCAGCCTCC<br>GGATTCACCTTTAGCAGTTATGCCATGAGCTGGGTCCG<br>CCAGGCTCCAGGGAAGGGGCTGGAGTGGGTCTCAGCT<br>ATTAGTGGTAGTGGTGGTAGCACATACTACGCAGACTC<br>CGTGAAGGGCCGGTTCACCATCTCCAGAGACAATTCCA<br>AGAACACGCTGTATCTGCAGATGAACAGCCTGAGAGC<br>CGAGGACACGGCCGTATATTACTGTGCGCGTGACGACC<br>CGTGGCCGCCGTTCGACTACTGGGGCCAAGGAACCCTG<br>GTCACCGTCTCGAGTGCTAGCACCAAGGGCCCATCGGT<br>CTTCCCCCTGGCACCCTCCTCCAAGAGCACCTCTGGGG<br>GCACAGCGGCCCTGGGCTGCCTGGTCAAGGACTACTTC<br>CCCGAACCGGTGACGGTGTCGTGGAACTCAGGCGCCCT<br>GACCAGCGGCGTGCACACCTTCCCGGCTGTCCTACAGT<br>CCTCAGGACTCTACTCCCTCAGCAGCGTGGTGACCGTG<br>CCCTCCAGCAGCTTGGGCACCCAGACCTACATCTGCAA<br>CGTGAATCACAAGCCCAGCAACACCAAGGTGGACAAG<br>AAAGTTGAGCCCAAATCTTGTGACAAAACTCACACATG<br>CCCACCGTGCCCAGCACCTGAAGCTGCAGGGGGACCG<br>TCAGTCTTCCTCTTCCCCCCAAAACCCAAGGACACCCT<br>CATGATCTCCCGGACCCCTGAGGTCACATGCGTGGTGG<br>TGGACGTGAGCCACGAAGACCCTGAGGTCAAGTTCAA<br>CTGGTACGTGGACGGCGTGGAGGTGCATAATGCCAAG<br>ACAAAGCCGCGGGAGGAGCAGTACAACAGCACGTACC<br>GTGTGGTCAGCGTCCTCACCGTCCTGCACCAGGACTGG<br>CTGAATGGCAAGGAGTACAAGTGCAAGGTCTCCAACA<br>AAGCCCTCGGCGCCCCCATCGAGAAAACCATCTCCAA<br>AGCCAAAGGGCAGCCCCGAGAACCACAGGTGTGCACC<br>CTGCCCCCATCCCGGGATGAGCTGACCAAGAACCAGG<br>TCAGCCTCTCGTGCGCAGTCAAAGGCTTCTATCCCAGC<br>GACATCGCCGTGGAGTGGGAGAGCAATGGGCAGCCGG<br>AGAACAACTACAAGACCACGCCTCCCGTGCTGGACTCC<br>GACGGCTCCTTCTTCCTCGTGAGCAAGCTCACCGTGGA |

TABLE 71-continued cDNA and amino acid sequences of mature bispecific 2 + 1 anti-4-1BB, anti-FAP human IgG1 P329GLALA. (constructs with a-FAP VH fused to hole and VL fused to knob chain, termed below hole-VH)

| SEQ ID NO: | Description | Sequence |
|---|---|---|
| | | CAAGAGCAGGTGGCAGCAGGGGAACGTCTTCTCATGC<br>TCCGTGATGCATGAGGCTCTGCACAACCACTACACGCA<br>GAAGAGCCTCTCCCTGTCTCCGGGTGGAGGCGGCGGA<br>AGCGGAGGAGGAGGATCCGGCGGCGGAGGTTCCGGAG<br>GCGGAGGATCCGAGGTGCAGCTGCTCGAAAGCGGCGG<br>AGGACTGGTGCAGCCTGGCGGCAGCCTGAGACTGTCTT<br>GCGCCGCCAGCGGCTTCACCTTCAGCAGCTACGCCATG<br>AGCTGGGTCCGCCAGGCCCCTGGCAAGGGACTGGAAT<br>GGGTGTCCGCCATCATCGGCTCTGGCGCCAGCACCTAC<br>TACGCCGACAGCGTGAAGGGCCGGTTCACCATCAGCC<br>GGGACAACAGCAAGAACACCCTGTACCTGCAGATGAA<br>CAGCCTGCGGGCCGAGGACACCGCCGTGTACTACTGC<br>GCCAAGGGATGGTTCGGCGGCTTCAACTACTGGGGAC<br>AGGGCACCCTGGTCACCGTGTCCAGC |
| 265 | (25G7) VLCL-light chain | see Table 70 |
| 338 | (25G7) VHCH1 Fc knob VL (4B9) (heavy chain 1) | EVQLLESGGGLVQPGGSLRLSCAASGFTFSSYAMSWVRQ<br>APGKGLEWVSAISGSGGSTYYADSVKGRFTISRDNSKNTL<br>YLQMNSLRAEDTAVYYCARDDPWPPFDYWGQGTLVTV<br>SSASTKGPSVFPLAPSSKSTSGGTAALGCLVKDYFPEPVT<br>VSWNSGALTSGVHTFPAVLQSSGLYSLSSVVTVPSSSLGT<br>QTYICNVNHKPSNTKVDKKVEPKSCDKTHTCPPCPAPEA<br>AGGPSVFLFPPKPKDTLMISRTPEVTCVVVDVSHEDPEVK<br>FNWYVDGVEVHNAKTKPREEQYNSTYRVVSVLTVLHQD<br>WLNGKEYKCKVSNKALGAPIEKTISKAKGQPREPQVYTL<br>PPCRDELTKNQVSLWCLVKGFYPSDIAVEWESNGQPENN<br>YKTTPPVLDSDGSFFLYSKLTVDKSRWQQGNVFSCSVMH<br>EALHNHYTQKSLSLSPGGGGSGGGGSGGGGSGGGGSEI<br>VLTQSPGTLSLSPGERATLSCRASQSVTSSYLAWYQQKPG<br>QAPRLLINVGSRRATGIPDRFSGSGSGTDFTLTISRLEPEDF<br>AVYYCQQGIMLPPTFGQGTKVEIK |
| 339 | (25G7) VHCH1 Fc hole VH (4B9) (heavy chain 2) | EVQLLESGGGLVQPGGSLRLSCAASGFTFSSYAMSWVRQ<br>APGKGLEWVSAISGSGGSTYYADSVKGRFTISRDNSKNTL<br>YLQMNSLRAEDTAVYYCARDDPWPPFDYWGQGTLVTV<br>SSASTKGPSVFPLAPSSKSTSGGTAALGCLVKDYFPEPVT<br>VSWNSGALTSGVHTFPAVLQSSGLYSLSSVVTVPSSSLGT<br>QTYICNVNHKPSNTKVDKKVEPKSCDKTHTCPPCPAPEA<br>AGGPSVFLFPPKPKDTLMISRTPEVTCVVVDVSHEDPEVK<br>FNWYVDGVEVHNAKTKPREEQYNSTYRVVSVLTVLHQD<br>WLNGKEYKCKVSNKALGAPIEKTISKAKGQPREPQVCTL<br>PPSRDELTKNQVSLSCAVKGFYPSDIAVEWESNGQPENN<br>YKTTPPVLDSDGSFFLVSKLTVDKSRWQQGNVFSCSVMH<br>EALHNHYTQKSLSLSPGGGGSGGGGSGGGGSGGGGSE<br>VQLLESGGGLVQPGGSLRLSCAASGFTFSSYAMSWVRQA<br>PGKGLEWVSAIIGSGASTYYADSVKGRFTISRDNSKNTLY<br>LQMNSLRAEDTAVYYCAKGWFGGFNYWGQGTLVTVSS |
| 267 | (11D5) VLCL-light chain (nucleotide sequence) | see Table 70 |
| 340 | (11D5) VHCH1 Fc knob VL (4B9) (nucleotide sequence, heavy chain 1) | CAGGTGCAATTGGTGCAGTCTGGGGCTGAGGTGAAGA<br>AGCCTGGGTCCTCGGTGAAGGTCTCCTGCAAGGCCTCC<br>GGAGGCACATTCAGCAGCTACGCTATAAGCTGGGTGC<br>GACAGGCCCCTGGACAAGGGCTCGAGTGGATGGGAGG<br>GATCATCCCTATCTTTGGTACAGCAAACTACGCACAGA<br>AGTTCCAGGGCAGGGTCACCATTACTGCAGACAAATCC<br>ACGAGCACAGCCTACATGGAGCTGAGCAGCCTGAGAT<br>CTGAGGACACCGCCGTGTATTACTGTGCGAGATCTACT<br>CTGATCTACGGTTACTTCGACTACTGGGGCCAAGGGAC<br>CACCGTGACCGTCTCCTCAGCTAGCACCAAGGGCCCAT<br>CGGTCTTCCCCCTGGCACCCTCCTCCAAGAGCACCTCT<br>GGGGGCACAGCGGCCCTGGGCTGCCTGGTCAAGGACT<br>ACTTCCCCGAACCGGTGACGGTGTCGTGGAACTCAGGC<br>GCCCTGACCAGCGGCGTGCACACCTTCCCGGCTGTCCT<br>ACAGTCCTCAGGACTCTACTCCCTCAGCAGCGTGGTGA<br>CCGTGCCCTCCAGCAGCTTGGGCACCCAGACCTACATC<br>TGCAACGTGAATCACAAGCCCAGCAACACCAAGGTGG<br>ACAAGAAAGTTGAGCCCAAATCTTGTGACAAAACTCA<br>CACATGCCCACCGTGCCCAGCACCTGAAGCTGCAGGG |

TABLE 71-continued cDNA and amino acid sequences of mature bispecific 2 + 1 anti-4-1BB, anti-FAP human IgG1 P329GLALA. (constructs with a-FAP VH fused to hole and VL fused to knob chain, termed below hole-VH)

| SEQ ID NO: | Description | Sequence |
|---|---|---|
| | | GGACCGTCAGTCTTCCTCTTCCCCCCAAAACCCAAGGA CACCCTCATGATCTCCCGGACCCCTGAGGTCACATGCG TGGTGGTGGACGTGAGCCACGAAGACCCTGAGGTCAA GTTCAACTGGTACGTGGACGGCGTGGAGGTGCATAAT GCCAAGACAAAGCCGCGGGAGGAGCAGTACAACAGCA CGTACCGTGTGGTCAGCGTCCTCACCGTCCTGCACCAG GACTGGCTGAATGGCAAGGAGTACAAGTGCAAGGTCT CCAACAAAGCCCTCGGCGCCCCCATCGAGAAAACCAT CTCCAAAGCCAAAGGGCAGCCCCGAGAACCACAGGTG TACACCCTGCCCCCCTGCAGAGATGAGCTGACCAAGA ACCAGGTGTCCCTGTGGTGTCTGGTCAAGGGCTTCTAC CCCAGCGATATCGCCGTGGAGTGGGAGAGCAACGGCC AGCCTGAGAACAACTACAAGACCACCCCCCCTGTGCTG GACAGCGACGGCAGCTTCTTCCTGTACTCCAAACTGAC CGTGGACAAGAGCCGGTGGCAGCAGGGCAACGTGTTC AGCTGCAGCGTGATGCACGAGGCCCTGCACAACCACT ACACCCAGAAGTCCCTGAGCCTGAGCCCCGGCGGAGG CGGCGGAAGCGGAGGAGGAGGATCTGGGGGCGGAGG TTCCGGAGGCGGTGGATCTGAGATCGTGCTGACCCAGT CTCCCGGCACCCTGTCTCTGAGCCCTGGCGAGAGAGCC ACCCTGTCCTGCAGAGCCTCCCAGTCCGTGACCTCCTC CTACCTCGCCTGGTATCAGCAGAAGCCCGGCCAGGCCC CTCGGCTGCTGATCAACGTGGGCAGTCGGAGAGCCAC CGGCATCCCTGACCGGTTCTCCGGCTCTGGCTCCGGCA CCGACTTCACCCTGACCATCTCCCGGCTGGAACCCGAG GACTTCGCCGTGTACTACTGCCAGCAGGGCATCATGCT GCCCCCCACCTTTGGCCAGGGCACCAAGGTGGAAATC AAG |
| 341 | (11D5) VHCH1 Fc hole VH (4B9) (nucleotide sequence, heavy chain 2) | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTCGAGTGGATGGGAGG GATCATCCCTATCTTTGGTACAGCAAACTACGCACAGA AGTTCCAGGGCAGGGTCACCATTACTGCAGACAAATCC ACGAGCACAGCCTACATGGAGCTGAGCAGCCTGAGAT CTGAGGACACCGCCGTGTATTACTGTGCGAGATCTACT CTGATCTACGGTTACTTCGACTACTGGGGCCAAGGGAC CACCGTGACCGTCTCCTCAGCTAGCACCAAGGGCCCAT CGGTCTTCCCCCTGGCACCCTCCTCCAAGAGCACCTCT GGGGGCACAGCGGCCCTGGGCTGCCTGGTCAAGGACT ACTTCCCCGAACCGGTGACGGTGTCGTGGAACTCAGGC GCCCTGACCAGCGGCGTGCACACCTTCCCGGCTGTCCT ACAGTCCTCAGGACTCTACTCCCTCAGCAGCGTGGTGA CCGTGCCCTCCAGCAGCTTGGGCACCCAGACCTACATC TGCAACGTGAATCACAAGCCCAGCAACACCAAGGTGG ACAAGAAAGTTGAGCCCAAATCTTGTGACAAAACTCA CACATGCCCACCGTGCCCAGCACCTGAAGCTGCAGGG GGACCGTCAGTCTTCCTCTTCCCCCCAAAACCCAAGGA CACCCTCATGATCTCCCGGACCCCTGAGGTCACATGCG TGGTGGTGGACGTGAGCCACGAAGACCCTGAGGTCAA GTTCAACTGGTACGTGGACGGCGTGGAGGTGCATAAT GCCAAGACAAAGCCGCGGGAGGAGCAGTACAACAGCA CGTACCGTGTGGTCAGCGTCCTCACCGTCCTGCACCAG GACTGGCTGAATGGCAAGGAGTACAAGTGCAAGGTCT CCAACAAAGCCCTCGGCGCCCCCATCGAGAAAACCAT CTCCAAAGCCAAAGGGCAGCCCCGAGAACCACAGGTG TGCACCCTGCCCCCATCCCGGGATGAGCTGACCAAGAA CCAGGTCAGCCTCTCGTGCGCAGTCAAAGGCTTCTATC CCAGCGACATCGCCGTGGAGTGGGAGAGCAATGGGCA GCCGGAGAACAACTACAAGACCACGCCTCCCGTGCTG GACTCCGACGGCTCCTTCTTCCTCGTGAGCAAGCTCAC CGTGGACAAGAGCAGGTGGCAGCAGGGGAACGTCTTC TCATGCTCCGTGATGCATGAGGCTCTGCACAACCACTA CACGCAGAAGAGCCTCTCCCTGTCTCCGGGTGGAGGCG GCGGAAGCGGAGGAGGAGGATCCGGCGGCGGAGGTTC CGGAGGCGGAGGATCCGAGGTGCAGCTGCTCGAAAGC GGCGGAGGACTGGTGCAGCCTGGCGCAGCCTGAGAC TGTCTTGCGCCGCCAGCGGCTTCACCTTCAGCAGCTAC GCCATGAGCTGGGTCCGCCAGGCCCTGGCAAGGGAC TGGAATGGGTGTCCGCCATCATCGGCTCTGGCGCCAGC ACCTACTACGCCGACAGCGTGAAGGGCCGGTTCACCAT CAGCCGGGACAACAGCAAGAACACCCTGTACCTGCAG |

TABLE 71-continued cDNA and amino acid sequences of mature bispecific 2 + 1 anti-4-1BB, anti-FAP human IgG1 P329GLALA. (constructs with a-FAP VH fused to hole and VL fused to knob chain, termed below hole-VH)

| SEQ ID NO: | Description | Sequence |
|---|---|---|
| | | ATGAACAGCCTGCGGGCCGAGGACACCGCCGTGTACT ACTGCGCCAAGGGATGGTTCGGCGGCTTCAACTACTGG GGACAGGGCACCCTGGTCACCGTGTCCAGC |
| 269 | (11D5) VLCL-light chain | see Table 70 |
| 342 | (11D5) VHCH1 Fc knob VL (4B9) (heavy chain 1) | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCARSTLIYGYFDYWGQGTTVTVS SASTKGPSVFPLAPSSKSTSGGTAALGCLVKDYFPEPVTV SWNSGALTSGVHTFPAVLQSSGLYSLSSVVTVPSSSLGTQ TYICNVNHKPSNTKVDKKVEPKSCDKTHTCPPCPAPEAA GGPSVFLFPPKPKDTLMISRTPEVTCVVVDVSHEDPEVKF NWYVDGVEVHNAKTKPREEQYNSTYRVVSVLTVLHQD WLNGKEYKCKVSNKALGAPIEKTISKAKGQPREPQVYTL PPCRDELTKNQVSLWCLVKGFYPSDIAVEWESNGQPENN YKTTPPVLDSDGSFFLYSKLTVDKSRWQQGNVFSCSVMH EALHNHYTQKSLSLSPGGGGGSGGGGSGGGGSGGGGSEI VLTQSPGTLSLSPGERATLSCRASQSVTSSYLAWYQQKPG QAPRLLINVGSRRATGIPDRFSGSGSGTDFTLTISRLEPEDF AVYYCQQGIMLPPTFGQGTKVEIK |
| 343 | (11D5) VHCH1 Fc hole VH (4B9) (heavy chain 2) | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCARSTLIYGYFDYWGQGTTVTVS SASTKGPSVFPLAPSSKSTSGGTAALGCLVKDYFPEPVTV SWNSGALTSGVHTFPAVLQSSGLYSLSSVVTVPSSSLGTQ TYICNVNHKPSNTKVDKKVEPKSCDKTHTCPPCPAPEAA GGPSVFLFPPKPKDTLMISRTPEVTCVVVDVSHEDPEVKF NWYVDGVEVHNAKTKPREEQYNSTYRVVSVLTVLHQD WLNGKEYKCKVSNKALGAPIEKTISKAKGQPREPQVCTL PPSRDELTKNQVSLSCAVKGFYPSDIAVEWESNGQPENN YKTTPPVLDSDGSFFLVSKLTVDKSRWQQGNVFSCSVMH EALHNHYTQKSLSLSPGGGGGSGGGGSGGGGSGGGGSE VQLLESGGGLVQPGGSLRLSCAASGFTFSSYAMSWVRQA PGKGLEWVSAIIGSGASTYYADSVKGRFTISRDNSKNTLY LQMNSLRAEDTAVYYCAKGWFGGFNYWGQGTLVTVSS |
| 271 | (9B11) VLCL-light chain (nucleotide sequence) | see Table 70 |
| 344 | (9B11) VHCH1 Fc knob VL (4B9) (nucleotide sequence, heavy chain 1) | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTCGAGTGGATGGGAGG GATCATCCCTATCTTTGGTACAGCAAACTACGCACAGA AGTTCCAGGGCAGGGTCACCATTACTGCAGACAAATCC ACGAGCACAGCCTACATGGAGCTGAGCAGCCTGAGAT CTGAGGACACCGCCGTGTATTACTGTGCGAGATCTTCT GGTGCTTACCCGGGTTACTTCGACTACTGGGGCCAAGG GACCACCGTGACCGTCTCCTCAGCTAGCACCAAGGGCC CATCGGTCTTCCCCCTGGCACCCTCCTCCAAGAGCACC TCTGGGGGCACAGCGGCCCTGGGCTGCCTGGTCAAGG ACTACTTCCCCGAACCGGTGACGGTGTCGTGGAACTCA GGCGCCCTGACCAGCGGCGTGCACACCTTCCCGGCTGT CCTACAGTCCTCAGGACTCTACTCCCTCAGCAGCGTGG TGACCGTGCCCTCCAGCAGCTTGGGCACCCAGACCTAC ATCTGCAACGTGAATCACAAGCCCAGCAACACCAAGG TGGACAAGAAAGTTGAGCCCAAATCTTGTGACAAAAC TCACACATGCCCACCGTGCCCAGCACCTGAAGCTGCAG GGGGACCGTCAGTCTTCCTCTTCCCCCCAAAACCCAAG GACACCCTCATGATCTCCCGGACCCCTGAGGTCACATG CGTGGTGGTGGACGTGAGCCACGAAGACCCTGAGGTC AAGTTCAACTGGTACGTGGACGGCGTGGAGGTGCATA ATGCCAAGACAAAGCCGCGGGAGGAGCAGTACAACAG CACGTACCGTGTGGTCAGCGTCCTCACCGTCCTGCACC AGGACTGGCTGAATGGCAAGGAGTACAAGTGCAAGGT CTCCAACAAAGCCCTCGGCGCCCCCATCGAGAAAACC ATCTCCAAAGCCAAAGGGCAGCCCCGAGAACCACAGG TGTACACCCTGCCCCCCTGCAGAGATGAGCTGACCAAG AACCAGGTGTCCCTGTGGTGTCTGGTCAAGGGCTTCTA |

TABLE 71-continued cDNA and amino acid sequences of mature bispecific 2 + 1 anti-4-1BB, anti-FAP human IgG1 P329GLALA. (constructs with a-FAP VH fused to hole and VL fused to knob chain, termed below hole-VH)

| SEQ ID NO: | Description | Sequence |
|---|---|---|
| | | CCCCAGCGATATCGCCGTGGAGTGGGAGAGCAACGGC CAGCCTGAGAACAACTACAAGACCACCCCCCCTGTGCT GGACAGCGACGGCAGCTTCTTCCTGTACTCCAAACTGA CCGTGGACAAGAGCCGGTGGCAGCAGGGCAACGTGTT CAGCTGCAGCGTGATGCACGAGGCCCTGCACAACCAC TACACCCAGAAGTCCCTGAGCCTGAGCCCCGGCGGAG GCGGCGGAAGCGGAGGAGGAGGATCTGGGGGCGGAG GTTCCGGAGGCGGTGGATCTGAGATCGTGCTGACCCAG TCTCCCGGCACCCTGTCTCTGAGCCCTGGCGAGAGAGC CACCCTGTCCTGCAGAGCCTCCCAGTCCGTGACCTCCT CCTACCTCGCCTGGTATCAGCAGAAGCCCGGCCAGGCC CCTCGGCTGCTGATCAACGTGGGCAGTCGGAGAGCCA CCGGCATCCCTGACCGGTTCTCCGGCTCTGGCTCCGGC ACCGACTTCACCCTGACCATCTCCCGGCTGGAACCCGA GGACTTCGCCGTGTACTACTGCCAGCAGGGCATCATGC TGCCCCCCACCTTTGGCCAGGGCACCAAGGTGGAAATC AAG |
| 345 | (9B11) VHCH1 Fc hole VH (4B9) (nucleotide sequence, heavy chain 2) | CAGGTGCAATTGGTGCAGTCTGGGGCTGAGGTGAAGA AGCCTGGGTCCTCGGTGAAGGTCTCCTGCAAGGCCTCC GGAGGCACATTCAGCAGCTACGCTATAAGCTGGGTGC GACAGGCCCCTGGACAAGGGCTCGAGTGGATGGGAGG GATCATCCCTATCTTTGGTACAGCAAACTACGCACAGA AGTTCCAGGGCAGGGTCACCATTACTGCAGACAAATCC ACGAGCACAGCCTACATGGAGCTGAGCAGCCTGAGAT CTGAGGACACCGCCGTGTATTACTGTGCGAGATCTTCT GGTGCTTACCCGGGTTACTTCGACTACTGGGGCCAAGG GACCACCGTGACCGTCTCCTCAGCTAGCACCAAGGGCC CATCGGTCTTCCCCCTGGCACCCTCCTCCAAGAGCACC TCTGGGGGCACAGCGGCCCTGGGCTGCCTGGTCAAGG ACTACTTCCCCGAACCGGTGACGGTGTCGTGGAACTCA GGCGCCCTGACCAGCGGCGTGCACACCTTCCCGGCTGT CCTACAGTCCTCAGGACTCTACTCCCTCAGCAGCGTGG TGACCGTGCCCTCCAGCAGCTTGGGCACCCAGACCTAC ATCTGCAACGTGAATCACAAGCCCAGCAACACCAAGG TGGACAAGAAAGTTGAGCCCAAATCTTGTGACAAAAC TCACACATGCCCACCGTGCCCAGCACCTGAACTGCAG GGGGACCGTCAGTCTTCCTCTTCCCCCCAAAACCCAAG GACACCCTCATGATCTCCCGGACCCCTGAGGTCACATG CGTGGTGGTGGACGTGAGCCACGAAGACCCTGAGGTC AAGTTCAACTGGTACGTGGACGGCGTGGAGGTGCATA ATGCCAAGACAAAGCCGCGGGAGGAGCAGTACAACAG CACGTACCGTGTGGTCAGCGTCCTCACCGTCCTGCACC AGGACTGGCTGAATGGCAAGGAGTACAAGTGCAAGGT CTCCAACAAAGCCCTCGGCGCCCCCATCGAGAAAACC ATCTCCAAAGCCAAAGGGCAGCCCCGAGAACCACAGG TGTGCACCCTGCCCCCATCCCGGGATGAGCTGACCAAG AACCAGGTCAGCCTCTCGTGCGCAGTCAAAGGCTTCTA TCCCAGCGACATCGCCGTGGAGTGGGAGAGCAATGGG CAGCCGGAGAACAACTACAAGACCACGCCTCCCGTGC TGGACTCCGACGGCTCCTTCTTCCTCGTGAGCAAGCTC ACCGTGGACAAGAGCAGGTGGCAGCAGGGGAACGTCT TCTCATGCTCCGTGATGCATGAGGCTCTGCACAACCAC TACACGCAGAAGAGCCTCTCCCTGTCTCCGGGTGGAGG CGGCGGAAGCGGAGGAGGAGGATCCGGCGGCGGAGG TTCCGGAGGCGGAGGATCCGAGGTGCAGCTGCTCGAA AGCGGCGGAGGACTGGTGCAGCCTGGCGGCAGCCTGA GACTGTCTTGCGCCGCCAGCGGCTTCACCTTCAGCAGC TACGCCATGAGCTGGGTCCGCCAGGCCCCTGGCAAGG GACTGGAATGGGTGTCCGCCATCATCGGCTCTGGCGCC AGCACCTACTACGCCGACAGCGTGAAGGGCCGGTTCA CCATCAGCCGGGACAACAGCAAGAACACCCTGTACCT GCAGATGAACAGCCTGCGGGCCGAGGACACCGCCGTG TACTACTGCGCCAAGGGATGGTTCGGCGGCTTCAACTA CTGGGGACAGGGCACCCTGGTCACCGTGTCCAGC |
| 273 | (9B11) VLCL-light chain | see Table 70 |
| 346 | (9B11) VHCH1 Fc knob VL (4B9) (heavy chain 1) | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCARSSGAYPGYFDYWGQGTTVT VSSASTKGPSVFPLAPSSKSTSGGTAALGCLVKDYFPEPV |

TABLE 71-continued cDNA and amino acid sequences of mature bispecific 2 + 1 anti-4-1BB, anti-FAP human IgG1 P329GLALA. (constructs with a-FAP VH fused to hole and VL fused to knob chain, termed below hole-VH)

| SEQ ID NO: | Description | Sequence |
|---|---|---|
| | | TVSWNSGALTSGVHTFPAVLQSSGLYSLSSVVTVPSSSLG TQTYICNVNHKPSNTKVDKKVEPKSCDKTHTCPPCPAPE AAGGPSVFLFPPKPKDTLMISRTPEVTCVVVDVSHEDPEV KFNWYVDGVEVHNAKTKPREEQYNSTYRVVSVLTVLHQ DWLNGKEYKCKVSNKALGAPIEKTISKAKGQPREPQVYT LPPCRDELTKNQVSLWCLVKGFYPSDIAVEWESNGQPEN NYKTTPPVLDSDGSFFLYSKLTVDKSRWQQGNVFSCSVM HEALHNHYTQKSLSLSPGGGGGSGGGGSGGGGSGGGGS EIVLTQSPGTLSLSPGERATLSCRASQSVTSSYLAWYQQK PGQAPRLLINVGSRRATGIPDRFSGSGSGTDFTLTISRLEPE DFAVYYCQQGIMLPPTFGQGTKVEIK |
| 347 | (9B11) VHCH1 Fc hole VH (4B9) (heavy chain 2) | QVQLVQSGAEVKKPGSSVKVSCKASGGTFSSYAISWVRQ APGQGLEWMGGIIPIFGTANYAQKFQGRVTITADKSTSTA YMELSSLRSEDTAVYYCARSSGAYPGYFDYWGQGTTVT VSSASTKGPSVFPLAPSSKSTSGGTAALGCLVKDYFPEPV TVSWNSGALTSGVHTFPAVLQSSGLYSLSSVVTVPSSSLG TQTYICNVNHKPSNTKVDKKVEPKSCDKTHTCPPCPAPE AAGGPSVFLFPPKPKDTLMISRTPEVTCVVVDVSHEDPEV KFNWYVDGVEVHNAKTKPREEQYNSTYRVVSVLTVLHQ DWLNGKEYKCKVSNKALGAPIEKTISKAKGQPREPQVCT LPPSRDELTKNQVSLSCAVKGFYPSDIAVEWESNGQPENN YKTTPPVLDSDGSFFLVSKLTVDKSRWQQGNVFSCSVMH EALHNHYTQKSLSLSPGGGGGSGGGGSGGGGSGGGGSE VQLLESGGGLVQPGGSLRLSCAASGFTFSSYAMSWVRQA PGKGLEWVSAIIGSGASTYYADSVKGRFTISRDNSKNTLY LQMNSLRAEDTAVYYCAKGWFGGFNYWGQGTLVTVSS |

TABLE 72

Biochemical analysis of bispecific constructs with a bivalent binding to 4-1BB and a monovalent binding to FAP (2 + 1 4-1BB/FAP human IgG1 P329GLALA)

| Clone | Yield [mg/l] | Monomer [%] | CE-SDS (nonred) |
|---|---|---|---|
| 2 + 1 25G7/FAP (hole-VH) | 25.6 | 96.7 | 95.4 |
| 2 + 1 11D5/FAP (hole-VH) | 6.3 | 97 | 89.2 |

11.2. Binding of Bispecific Monovalent Antibodies Targeting 4-1BB and FAP

11.2.1. Surface Plasmon Resonance (Simultaneous Binding)

The capacity of binding simultaneously to human 4-1BB Fc(kih) and human FAP was assessed by surface plasmon resonance (SPR). All SPR experiments were performed on a Biacore T200 at 25° C. with HBS-EP as running buffer (0.01 M HEPES pH 7.4, 0.15 M NaCl, 3 mM EDTA, 0.005% Surfactant P20, Biacore, Freiburg/Germany).

Biotinylated human 4-1BB Fc(kih) was directly coupled to a flow cell of a streptavidin (SA) sensor chip. Immobilization levels up to 400 resonance units (RU) were used. The bispecific antibodies targeting 4-1BB and FAP were passed at a concentration range of 200 nM with a flow of 30 µL/minute through the flow cells over 90 seconds and dissociation was set to zero sec. Human FAP was injected as second analyte with a flow of 30 µL/minute through the flow cells over 90 seconds at a concentration of 500 nM. The dissociation was monitored for 120 sec. Bulk refractive index differences were corrected for by subtracting the response obtained in a reference flow cell, where no protein was immobilized.

Figure 37B:
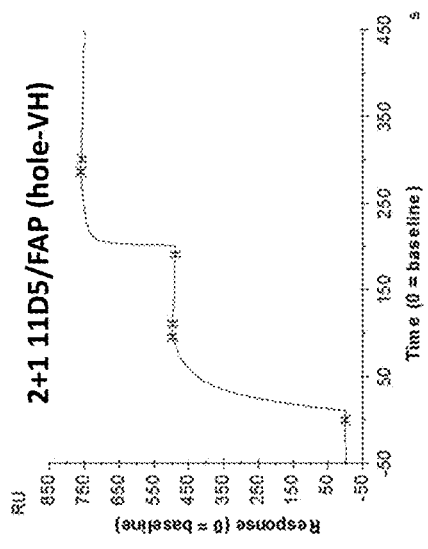
FIGS. 37A, 37B and 37C relate to the simultaneous binding of bispecific 2+1 anti-4-1BB and anti-FAP constructs.
Figure 37C:
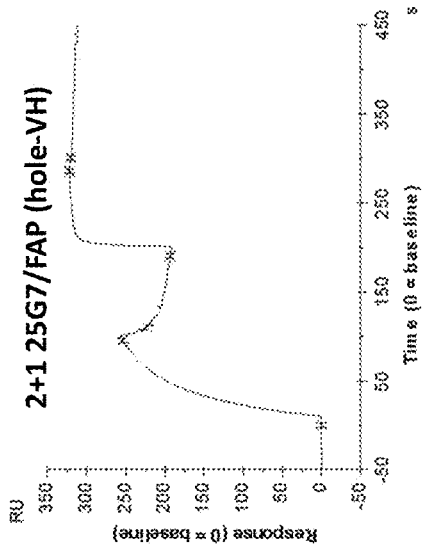
Figure 37A:
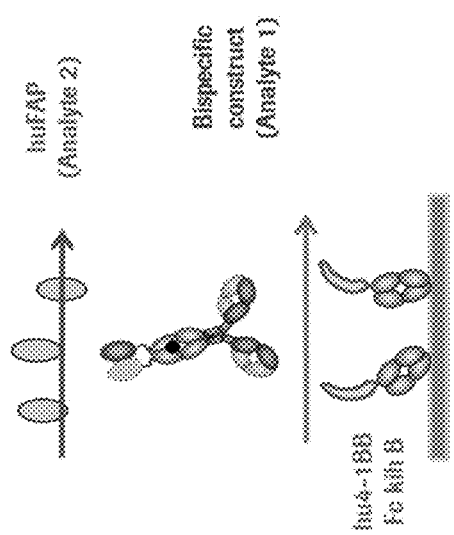
Figure 38A:
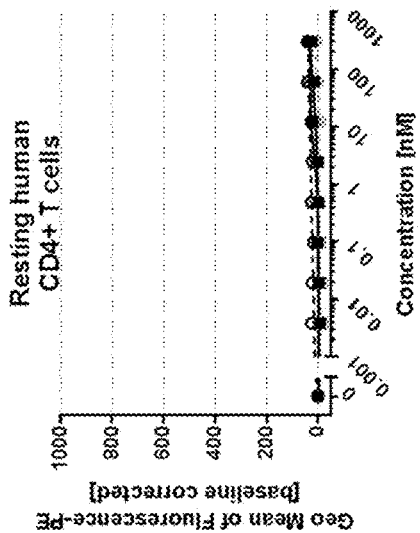
Figure 38B:
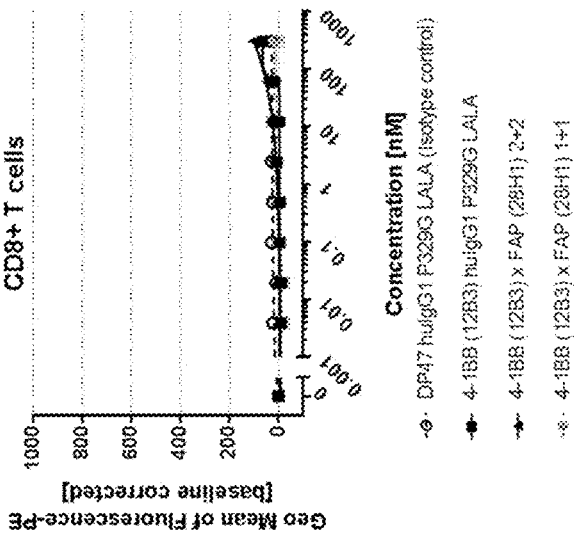
Figure 38C:
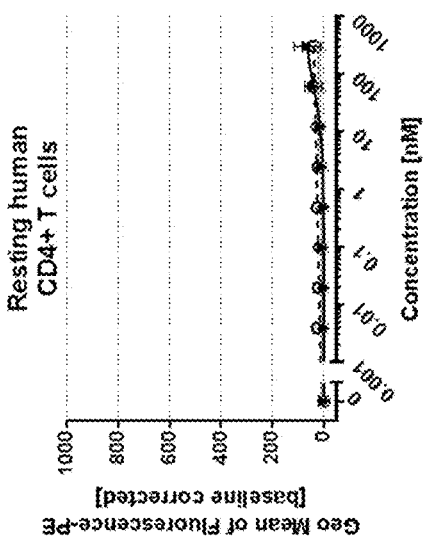
Figure 38D:
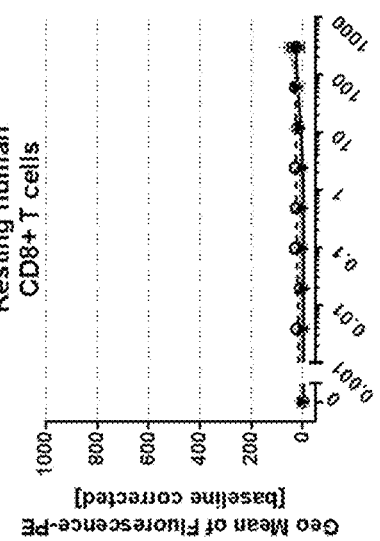

As shown in FIGS. 37B and 37C, all bispecific constructs could bind simultaneously to human 4-1BB and human FAP.

11.2.2 NFκB Activation

The generation of NFκB-reporter cell line HeLa-huCD137-NFκB-luc clone 26 as well as the set up of the activation assay has already been described under 9.2.3.

Figure 44A:
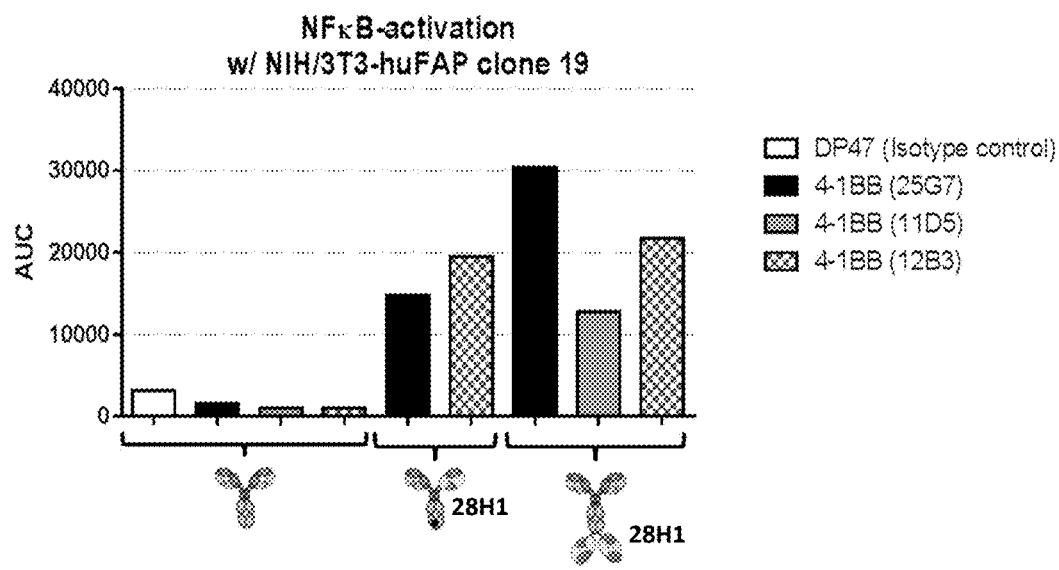
FIGS. 44A and 44B summarize the NF-κB-mediated luciferase activity in the 4-1BB-expressing reporter cell line HeLa-hu4-1BB-NFkB-luc in the presence of NIH/3T3-hu-FAP cells. Shown is the area under the curve (AUC) of the activation curves in the presence of NIH/3T3-huFAP cells. Used antibody formats and anti-FAP clones are indicated as pictograms under the graph, the different agonistic 4-1BB clones are indicated with different column patterns: DP47 control molecule in white, 25G7 containing molecules in black, clone 11D5 in grey and clone 12B3 in white/black-check. The graph shows that only FAP-targeted molecules can induce a strong activation above background. Activation levels depend on the clone, FAP-targeting and the format.
Figure 44B:
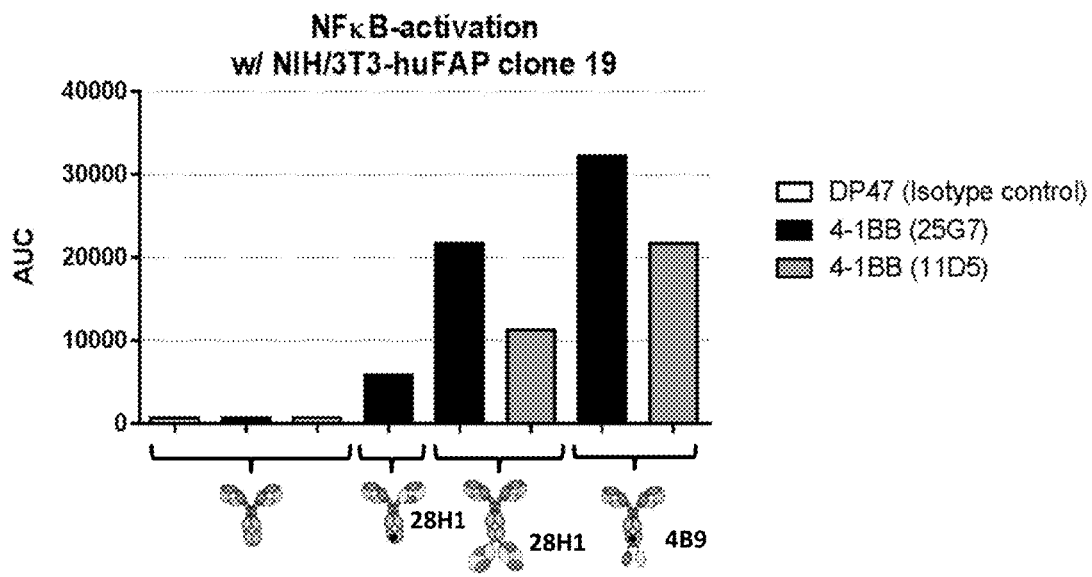

The tested FAP (4B9)-targeted 2+1 constructs containing clone 11D5 (FIG. 44A-44C) or clone 25G7 (Figure G-I) triggered activation of the NFkB signaling pathway in the reporter cell line in the presence of FAP-expressing tumor cells. This activity was strictly dependent on the expression of FAP at the cell surface of tumor cells as no NF-κB activation could be detected in the absence of FAP-expressing tumor cells (FIGS. 43D and 43G). Different to the other tested formats (e.g. 2+2, 1+1) the FAP (4B9)-targeted 2+1 could also induce an activation in the presence of lower FAP-expressing WM-266-4 cells (FIGS. 44E and H). In the presences of NIH/3T3-huFAP clone 19 binders the 2+1 fromats are also superior compared to the FAP (28H1)-targeted 2+2 or 1+1 constructs (FIGS. 43F and 43I, FIG. 44B). This may be explained with the stronger FAP-binder (4B9>28H1) and the different ratio between FAP-binding sides and 4-1BB binding sides (1:2 versus 1:1).

TABLE 73

$EC_{50}$ values of activation of the NFκB signaling pathway in the presence of FAP-expressing tumor cells

| Clone | $EC_{50}$ [nM] with NIH/3T3-huFAP clone 19 cells | $EC_{50}$ [nM] with WM-266-4 |
|---|---|---|
| 4-1BB(25G7)/ FAP(4B9) 2 + 1 | 0.1 | 0.3 |
| 4-1BB(11D5)/ FAP(4B9) 2 + 1 | 0.3 | 0.4 |

SEQUENCE LISTING (347 sequences)

SEQ ID NO: 1 - protein, 186 aa, Homo sapiens [sequence omitted]

SEQ ID NO: 2 - protein, 5 aa, Artificial sequence
  OX40(8H9,49B4,1G4, 20B7)  CDR-H1
SYAIS

SEQ ID NO: 3 - protein, 5 aa, Artificial sequence
  OX40(CLC-563, CLC-564, 17A9)  CDR-H1
SYAMS

SEQ ID NO: 4 - protein, 17 aa, Artificial sequence
  OX40(8H9,49B4,1G4, 20B7)  CDR-H2
GIIPIFGTANYAQKFQG

SEQ ID NO: 5 - protein, 17 aa, Artificial sequence
  OX40(CLC-563, CLC-564, 17A9)  CDR-H2
AISGSGGSTYYADSVKG

SEQ ID NO: 6 - protein, 7 aa, Artificial sequence
  OX40(8H9)  CDR-H3
EYGWMDY

SEQ ID NO: 7 - protein, 9 aa, Artificial sequence
  OX40(49B4)  CDR-H3
EYYRGPYDY

SEQ ID NO: 8 - protein, 7 aa, Artificial sequence
  OX40(1G4)  CDR-H3
EYGSMDY

SEQ ID NO: 9 - protein, 13 aa, Artificial sequence
  OX40(20B7)  CDR-H3
VNYPYSYWGDFDY

SEQ ID NO: 10 - protein, 7 aa, Artificial sequence
  OX40(CLC-563)  CDR-H3
DVGAFDY

SEQ ID NO: 11 - protein, 7 aa, Artificial sequence
  OX40(CLC-564)  CDR-H3
DVGPFDY

SEQ ID NO: 12 - protein, 11 aa, Artificial sequence
  OX40(17A9)-CDR-H3
VFYRGGVSMDY

SEQ ID NO: 13 - protein, 11 aa, Artificial sequence
  OX40(8H9,49B4,1G4, 20B7)  CDR-L1
RASQSISSWLA

SEQ ID NO: 14 - protein, 12 aa, Artificial sequence
  OX40(CLC-563, CLC564)  CDR-L1
RASQSVSSSYLA

SEQ ID NO: 15 - protein, 11 aa, Artificial sequence
  OX40(17A9) CDR-L1
QGDSLRSYYAS

SEQ ID NO: 16 - protein, 7 aa, Artificial sequence
  OX40(8H9,49B4,1G4, 20B7)  CDR-L2
DASSLES

SEQ ID NO: 17 - protein, 7 aa, Artificial sequence
  OX40(CLC-563, CLC564)  CDR-L2
GASSRAT

SEQ ID NO: 18 - protein, 7 aa, Artificial sequence
  OX40(17A9) CDR-L2
GKNNRPS

SEQ ID NO: 19 - protein, 10 aa, Artificial sequence
  OX40(8H9)  CDR-L3
QQYLTYSRFT

SEQ ID NO: 20 - protein, 9 aa, Artificial sequence
  OX40(49B4)  CDR-L3
QQYSSQPYT

SEQ ID NO: 21 - protein, 10 aa, Artificial sequence
  OX40(1G4)  CDR-L3
QQYISYSMLT

SEQ ID NO: 22 - protein, 9 aa, Artificial sequence
  OX40(20B7)  CDR-L3
QQYQAFSLT

SEQ ID NO: 23 - protein, 9 aa, Artificial sequence
  OX40(CLC-563, CLC-164)  CDR-L3
QQYGSSPLT

SEQ ID NO: 24 - protein, 10 aa, Artificial sequence
  OX40(17A9) CDR-L3
NSRVMPHNRV

SEQ ID NO: 25 - protein, 116 aa, Artificial sequence
  OX40(8H9)  VH
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYGWMDYWGQGTTVTVSS

SEQ ID NO: 26 - protein, 108 aa, Artificial sequence
  OX40(8H9)  VL
DIQMTQSPSTLSASVGDRVTITCRASQSISSWLAWYQQKPGKAPKLLIYDASSLESGVPSRFSGSGSGTEFTLTISSLQPDDFATYYCQQYLTYSRFTFGQGTKVEIK

SEQ ID NO: 27 - protein, 118 aa, Artificial sequence
  OX40(49B4)  VH
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYRGPYDYWGQGTTVTVSS

SEQ ID NO: 28 - protein, 107 aa, Artificial sequence
  OX40(49B4)  VL
DIQMTQSPSTLSASVGDRVTITCRASQSISSWLAWYQQKPGKAPKLLIYDASSLESGVPSRFSGSGSGTEFTLTISSLQPDDFATYYCQQYSSQPYTFGQGTKVEIK

SEQ ID NO: 29 - protein, 116 aa, Artificial sequence
  OX40(1G4)  VH
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYGSMDYWGQGTTVTVSS

SEQ ID NO: 30 - protein, 108 aa, Artificial sequence
  OX40(1G4)  VL
DIQMTQSPSTLSASVGDRVTITCRASQSISSWLAWYQQKPGKAPKLLIYDASSLESGVPSRFSGSGSGTEFTLTISSLQPDDFATYYCQQYISYSMLTFGQGTKVEIK

SEQ ID NO: 31 - protein, 122 aa, Artificial sequence
  OX40(20B7)  VH
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARVNYPYSYWGDFDYWGQGTTVTVSS

SEQ ID NO: 32 - protein, 107 aa, Artificial sequence
  OX40(20B7)  VL
DIQMTQSPSTLSASVGDRVTITCRASQSISSWLAWYQQKPGKAPKLLIYDASSLESGVPSRFSGSGSGTEFTLTISSLQPDDFATYYCQQYQAFSLTFGQGTKVEIK

SEQ ID NO: 33 - protein, 116 aa, Artificial sequence
  OX40(CLC-563)  VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCALDVGAFDYWGQGALVTVSS

SEQ ID NO: 34 - protein, 108 aa, Artificial sequence
  OX40(CLC-563)  VL
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIK

SEQ ID NO: 35 - protein, 116 aa, Artificial sequence
  OX40(CLC-564)  VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAFDVGPFDYWGQGTLVTVSS

SEQ ID NO: 36 - protein, 108 aa, Artificial sequence; identical to SEQ ID NO: 34
  OX40(CLC-564)  VL

SEQ ID NO: 37 - protein, 120 aa, Artificial sequence
  OX40(17A9)  VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARVFYRGGVSMDYWGQGTLVTVSS

SEQ ID NO: 38 - protein, 106 aa, Artificial sequence
  OX40(17A9)  VL
SSELTQDPAVSVALGQTVRITCQGDSLRSYYASWYQQKPGQAPVLVIYGKNNRPSGIPDRFSGSSSGNTASLTITGAQAEDEADYYCNSRVMPHNRVFGGGTKLTV

SEQ ID NO: 39 - protein, 163 aa, Homo sapiens
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQ

SEQ ID NO: 40 - protein, 5 aa, Artificial Sequence
  4-1BB(12B3,11D5, 9B11, 20G2)  CDR-H1
SYAIS

SEQ ID NO: 41 - protein, 5 aa, Artificial Sequence
  4-1BB(25G7)  CDR-H1
SYAMS

SEQ ID NO: 42 - protein, 17 aa, Artificial Sequence
  4-1BB(12B3,11D5, 9B11, 20G2)  CDR-H2
GIIPIFGTANYAQKFQG

SEQ ID NO: 43 - protein, 17 aa, Artificial Sequence
  4-1BB(25G7)  CDR-H2
AISGSGGSTYYADSVKG

SEQ ID NO: 44 - protein, 11 aa, Artificial Sequence
  4-1BB(12B3)  CDR-H3
SEFRFYADFDY

SEQ ID NO: 45 - protein, 9 aa, Artificial Sequence
  4-1BB(25G7)  CDR-H3
DDPWPPFDY

SEQ ID NO: 46 - protein, 10 aa, Artificial Sequence
  4-1BB(11D5)  CDR-H3
STLIYGYFDY

SEQ ID NO: 47 - protein, 11 aa, Artificial Sequence
  4-1BB(9B11)  CDR-H3
SSGAYPGYFDY

SEQ ID NO: 48 - protein, 11 aa, Artificial Sequence
  4-1BB(20G2)  CDR-H3
SYYWESYPFDY

SEQ ID NO: 49 - protein, 11 aa, Artificial Sequence
  4-1BB(12B3,11D5, 9B11, 20G2)  CDR-L1
RASQSISSWLA

SEQ ID NO: 50 - protein, 11 aa, Artificial Sequence
  4-1BB(25G7)  CDR-L1
QGDSLRSYYAS

SEQ ID NO: 51 - protein, 7 aa, Artificial Sequence
  4-1BB(12B3,11D5, 9B11, 20G2)  CDR-L2
DASSLES

SEQ ID NO: 52 - protein, 7 aa, Artificial Sequence
  4-1BB(25G7)  CDR-L2
GKNNRPS

SEQ ID NO: 53 - protein, 9 aa, Artificial Sequence
  4-1BB(12B3)  CDR-L3
QQYHSYPQT

SEQ ID NO: 54 - protein, 10 aa, Artificial Sequence
  4-1BB(25G7)  CDR-L3
NSLDRRGMWV

SEQ ID NO: 55 - protein, 9 aa, Artificial Sequence
  4-1BB(11D5)  CDR-L3
QQLNSYPQT

SEQ ID NO: 56 - protein, 9 aa, Artificial Sequence
  4-1BB(9B11)  CDR-L3
QQVNSYPQT

SEQ ID NO: 57 - protein, 8 aa, Artificial Sequence
  4-1BB(20G2)  CDR-L3
QQQHSYYT

SEQ ID NO: 58 - protein, 120 aa, Artificial Sequence
  4-1BB(12B3)  VH
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSEFRFYADFDYWGQGTTVTVSS

SEQ ID NO: 59 - protein, 107 aa, Artificial Sequence
  4-1BB(12B3)  VL
DIQMTQSPSTLSASVGDRVTITCRASQSISSWLAWYQQKPGKAPKLLIYDASSLESGVPSRFSGSGSGTEFTLTISSLQPDDFATYYCQQYHSYPQTFGQGTKVEIK

SEQ ID NO: 60 - protein, 118 aa, Artificial Sequence
  4-1BB(25G7)  VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDDPWPPFDYWGQGTLVTVSS

SEQ ID NO: 61 - protein, 106 aa, Artificial Sequence
  4-1BB(25G7)  VL
SSELTQDPAVSVALGQTVRITCQGDSLRSYYASWYQQKPGQAPVLVIYGKNNRPSGIPDRFSGSSSGNTASLTITGAQAEDEADYYCNSLDRRGMWVFGGGTKLTV

SEQ ID NO: 62 - protein, 119 aa, Artificial Sequence
  4-1BB(11D5)  VH
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSTLIYGYFDYWGQGTTVTVSS

SEQ ID NO: 63 - protein, 107 aa, Artificial Sequence
  4-1BB(11D5)  VL
DIQMTQSPSTLSASVGDRVTITCRASQSISSWLAWYQQKPGKAPKLLIYDASSLESGVPSRFSGSGSGTEFTLTISSLQPDDFATYYCQQLNSYPQTFGQGTKVEIK

SEQ ID NO: 64 - protein, 120 aa, Artificial Sequence
  4-1BB(9B11)  VH
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSSGAYPGYFDYWGQGTTVTVSS

SEQ ID NO: 65 - protein, 107 aa, Artificial Sequence
  4-1BB(9B11)  VL
DIQMTQSPSTLSASVGDRVTITCRASQSISSWLAWYQQKPGKAPKLLIYDASSLESGVPSRFSGSGSGTEFTLTISSLQPDDFATYYCQQVNSYPQTFGQGTKVEIK

SEQ ID NO: 66 - protein, 120 aa, Artificial Sequence
  4-1BB(20G2)  VH
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSYYWESYPFDYWGQGTTVTVSS

SEQ ID NO: 67 - protein, 106 aa, Artificial Sequence
  4-1BB(20G2)  VL
DIQMTQSPSTLSASVGDRVTITCRASQSISSWLAWYQQKPGKAPKLLIYDASSLESGVPSRFSGSGSGTEFTLTISSLQPDDFATYYCQQQHSYYTFGQGTKVEIK

SEQ ID NO: 68 - protein, 5 aa, Artificial Sequence
  FAP(28H1)  CDR-H1
SHAMS

SEQ ID NO: 69 - protein, 5 aa, Artificial Sequence
  FAP(4B9)  CDR-H1
SYAMS

SEQ ID NO: 70 - protein, 16 aa, Artificial Sequence
  FAP(28H1)  CDR-H2
AIWASGEQYYADSVKG

SEQ ID NO: 71 - protein, 17 aa, Artificial Sequence
  FAP(4B9)  CDR-H2
AIIGSGASTYYADSVKG

SEQ ID NO: 72 - protein, 8 aa, Artificial Sequence
  FAP(28H1)  CDR-H3
GWLGNFDY

SEQ ID NO: 73 - protein, 8 aa, Artificial Sequence
  FAP(4B9)  CDR-H3
GWFGGFNY

SEQ ID NO: 74 - protein, 12 aa, Artificial Sequence
  FAP(28H1)  CDR-L1
RASQSVSRSYLA

SEQ ID NO: 75 - protein, 12 aa, Artificial Sequence
  FAP(4B9)  CDR-L1
RASQSVTSSYLA

SEQ ID NO: 76 - protein, 7 aa, Artificial Sequence
  FAP(28H1)  CDR-L2
GASTRAT

SEQ ID NO: 77 - protein, 7 aa, Artificial Sequence
  FAP(4B9)  CDR-L2
VGSRRAT

SEQ ID NO: 78 - protein, 9 aa, Artificial Sequence
  FAP(28H1)  CDR-L3
QQGQVIPPT

SEQ ID NO: 79 - protein, 9 aa, Artificial Sequence
  FAP(4B9)  CDR-L3
QQGIMLPPT

SEQ ID NO: 80 - protein, 116 aa, Artificial Sequence
  FAP(28H1) VH
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 81 - protein, 108 aa, Artificial Sequence
  FAP(28H1) VL
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIK

SEQ ID NO: 82 - protein, 117 aa, Artificial Sequence
  FAP(4B9) VH
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 83 - protein, 108 aa, Artificial Sequence
  FAP(4B9) VL
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 84 - protein, 760 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 85 - protein, 748 aa, Artificial Sequence
  hu FAP ectodomain+poly-lys-tag+his6-tag
RPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSDGKKKKKKGHHHHHH

SEQ ID NO: 86 - DNA, 2244 bp, Artificial Sequence
  hu FAP ectodomain+poly-lys-tag+his6-tag
cgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagacggcaaaaagaaaaagaaaaagggccaccaccatcaccatcac

SEQ ID NO: 87 - protein, 761 aa, Mus musculus
MKTWLKTVFGVTTLAALALVVICIVLRPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGISSGRSQNHLYTHMTHFLKQCFSLSD

SEQ ID NO: 88 - protein, 749 aa, Artificial Sequence
  Murine FAP ectodomain+poly-lys-tag+his6-tag
RPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGILSGRSQNHLYTHMTHFLKQCFSLSDGKKKKKKGHHHHHH

SEQ ID NO: 89 - DNA, 2247 bp, Artificial Sequence
  Murine FAP ectodomain+poly-lys-tag+his6-tag
cgtccctcaagagtttacaaacctgaaggaaacacaaagagagctcttaccttgaaggatattttaaatggaacattctcatataaaacatattttcccaactggatttcagaacaagaatatcttcatcaatctgaggatgataacatagtattttataatattgaaacaagagaatcatatatcattttgagtaatagcaccatgaaaagtgtgaatgctacagattatggtttgtcacctgatcggcaatttgtgtatctagaaagtgattattcaaagctctggcgatattcatacacagcgacatactacatctacgaccttcagaatggggaatttgtaagaggatacgagctccctcgtccaattcagtatctatgctggtcgcctgttgggagtaaattagcatatgtatatcaaaacaatatttatttgaaacaaagaccaggagatccaccttttcaaataacttatactggaagagaaaatagaatatttaatggaataccagactgggtttatgaagaggaaatgcttgccacaaaatatgctctttggtggtctccagatggaaaatttttggcatatgtagaatttaatgattcagatataccaattattgcctattcttattatggtgatggacagtatcctagaactataaatattccatatccaaaggctggggctaagaatccggttgttcgtgtttttattgttgacaccacctaccctcaccacgtgggcccaatggaagtgccagttccagaaatgatagcctcaagtgactattatttcagctggctcacatgggtgtccagtgaacgagtatgcttgcagtggctaaaaagagtgcagaatgtctcagtcctgtctatatgtgatttcagggaagactggcatgcatgggaatgtccaaagaaccaggagcatgtagaagaaagcagaacaggatgggctggtggattctttgtttcgacaccagcttttagccaggatgccacttcttactacaaaatatttagcgacaaggatggttacaaacatattcactacatcaaagacactgtggaaaatgctattcaaattacaagtggcaagtgggaggccatatatatattccgcgtaacacaggattcactgttttattctagcaatgaatttgaaggttaccctggaagaagaaacatctacagaattagcattggaaactctcctccgagcaagaagtgtgttacttgccatctaaggaaagaaaggtgccaatattacacagcaagtttcagctacaaagccaagtactatgcactcgtctgctatggccctggcctccccatttccaccctccatgatggccgcacagaccaagaaatacaagtattagaagaaaacaaagaactggaaaattctctgagaaatatccagctgcctaaagtggagattaagaagctcaaagacgggggactgactttctggtacaagatgattctgcctcctcagtttgacagatcaaagaagtaccctttgctaattcaagtgtatggtggtccttgtagccagagtgttaagtctgtgtttgctgttaattggataacttatctcgcaagtaaggaggggatagtcattgccctggtagatggtcggggcactgctttccaaggtgacaaattcctgcatgccgtgtatcgaaaactgggtgtatatgaagttgaggaccagctcacagctgtcagaaaattcatagaaatgggtttcattgatgaagaaagaatagccatatggggctggtcctacggaggttatgtttcatccctggcccttgcatctggaactggtcttttcaaatgtggcatagcagtggctccagtctccagctgggaatattacgcatctatctactcagagagattcatgggcctcccaacaaaggacgacaatctcgaacactataaaaattcaactgtgatggcaagagcagaatatttcagaaatgtagactatcttctcatccacggaacagcagatgataatgtgcactttcagaactcagcacagattgctaaagctttggttaatgcacaagtggatttccaggcgatgtggtactctgaccagaaccatggtatattatctgggcgctcccagaatcatttatatacccacatgacgcacttcctcaagcaatgcttttctttatcagacggcaaaaagaaaaagaaaaagggccaccaccatcaccatcac

SEQ ID NO: 90 - protein, 748 aa, Artificial Sequence
  Cynomolgus FAP ectodomain+poly-lys-tag+his6-tag
RPPRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPFVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEDYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSDGKKKKKKGHHHHHH

SEQ ID NO: 91 - DNA, 2244 bp, Artificial Sequence
  Cynomolgus FAP ectodomain+poly-lys-tag+his6-tag
cgccctccaagagttcataactctgaagaaaatacaatgagagcactcacactgaaggatattttaaatgggacattttcttataaaacattttttccaaactggatttcaggacaagaatatcttcatcaatctgcagataacaatatagtactttataatattgaaacaggacaatcatataccattttgagtaacagaaccatgaaaagtgtgaatgcttcaaattatggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacagatataccagttattgcctattcctattatggcgatgaacaatatcccagaacaataaatattccatacccaaaggccggagctaagaatccttttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcttgtctatatgtgatttcagggaagactggcagacatgggattgtccaaagacccaggagcatatagaagaaagcagaactggatgggctggtggattctttgtttcaacaccagttttcagctatgatgccatttcatactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagattaccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctatggcccaggcatccccatttccacccttcatgacggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcggggaacagctttccaaggtgacaaactcctgtatgcagtgtatcgaaagctgggtgtttatgaagttgaagaccagattacagctgtcagaaaattcatagaaatgggtttcattgatgaaaaaagaatagccatatggggctggtcctatggaggatatgtttcatcactggcccttgcatctggaactggtcttttcaaatgtgggatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagacggcaaaaagaaaaagaaaaagggccaccaccatcaccatcac

SEQ ID NO: 92 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNKLSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 93 - protein, 2322 aa, Homo sapiens
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 94 - protein, 1210 aa, Homo sapiens [sequence omitted]

SEQ ID NO: 95 - protein, 556 aa, Homo sapiens [sequence omitted]

SEQ ID NO: 96 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 97 - protein, 364 aa, Homo sapiens
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 98 - protein, 277 aa, Homo sapiens
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 99 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 100 - protein, 260 aa, Homo sapiens
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCHYSCPREEEGSTIPIQEDYRKPEPACSP

SEQ ID NO: 101 - protein, 283 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 102 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 103 - protein, 241 aa, Homo sapiens
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 104 - protein, 272 aa, Mus musculus
MYVWVQQPTALLLLALTLGVTARRLNCVKHTYPSGHKCCRECQPGHGMVSRCDHTRDTLCHPCETGFYNEAVNYDTCKQCTQCNHRSGSELKQNCTPTQDTVCRCRPGTQPRQDSGYKLGVDCVPCPPGHFSPGNNQACKPWTNCTLSGKQTRHPASDSLDAVCEDRSLLATLLWETQRPTFRPTTVQSTTVWPRTSELPSPPTLVTPEGPAFAVLLGLGLGLLAPLTVLLALYLLRKAWRLPNTPKPCWGNSFRTPIQEEHTDAHFTLAKI

SEQ ID NO: 105 - protein, 256 aa, Mus musculus
MGNNCYNVVVIVLLLVGCEKVGAVQNSCDNCQPGTFCRKYNPVCKSCPPSTFSSIGGQPNCNICRVCAGYFRFKKFCSSTHNAECECIEGFHCLGPQCTRCEKDCRPGQELTKQGCKTCSLGTFNDQNGTGVCRPWTNCSLDGRSVLKTGTTEKDVVCGPPVVSFSPSTTISVTPEGGPGGHSLQVLTLFLALTSALLLALIFITLLFSVLKWIRKKFPHIFKQPFKKTTGAAQEEDACSCRCPQEEEGGGGGYEL

SEQ ID NO: 106 - protein, 254 aa, cynomolgus
MGNSCYNIVATLLLVLNFERTRSLQDLCSNCPAGTFCDNNRSQICSPCPPNSFSSAGGQRTCDICRQCKGVFKTRKECSSTSNAECDCISGYHCLGAECSMCEQDCKQGQELTKKGCKDCCFGTFNDQKRGICRPWTNCSLDGKSVLVNGTKERDVVCGPSPADLSPGASSATPPAPAREPGHSPQIIFFLALTSTVVLFLLFFLVLRFSVVKRSRKKLLYIFKQPFMRPVQTTQEEDGCSCRFPEEEEGGCEL

SEQ ID NO: 107 - protein, 5 aa, Artificial sequence
  Peptide linker
GGGGS

SEQ ID NO: 108 - protein, 10 aa, Artificial sequence
  Peptide linker
GGGGSGGGGS

SEQ ID NO: 109 - protein, 10 aa, Artificial sequence
  Peptide linker
SGGGGSGGGG

SEQ ID NO: 110 - protein, 14 aa, Artificial sequence
  Peptide linker
GGGGSGGGGSGGGG

SEQ ID NO: 111 - protein, 10 aa, Artificial sequence
  Peptide linker
GSPGSSSSGS

SEQ ID NO: 112 - protein, 15 aa, Artificial sequence
  Peptide linker
GGGGSGGGGSGGGGS

SEQ ID NO: 113 - protein, 20 aa, Artificial sequence
  Peptide linker
GGGGSGGGGSGGGGSGGGGS

SEQ ID NO: 114 - protein, 8 aa, Artificial sequence
  Peptide linker
GSGSGSGS

SEQ ID NO: 115 - protein, 8 aa, Artificial sequence
  Peptide linker
GSGSGNGS

SEQ ID NO: 116 - protein, 8 aa, Artificial sequence
  Peptide linker
GGSGSGSG

SEQ ID NO: 117 - protein, 6 aa, Artificial sequence
  Peptide linker
GGSGSG

SEQ ID NO: 118 - protein, 4 aa, Artificial sequence
  Peptide linker
GGSG

SEQ ID NO: 119 - protein, 8 aa, Artificial sequence
  Peptide linker
GGSGNGSG

SEQ ID NO: 120 - protein, 8 aa, Artificial sequence
  Peptide linker
GGNGSGSG

SEQ ID NO: 121 - protein, 6 aa, Artificial sequence
  Peptide linker
GGNGSG

SEQ ID NO: 122 - protein, 186 aa, cynomolgus
LHCVGDTYPSNDRCCQECRPGNGMVSRCNRSQNTVCRPCGPGFYNDVVSAKPCKACTWCNLRSGSERKQPCTATQDTVCRCRAGTQPLDSYKPGVDCAPCPPGHFSPGDNQACKPWTNCTLAGKHTLQPASNSSDAICEDRDPPPTQPQETQGPPARPTTVQPTEAWPRTSQRPSTRPVEVPRGPA

SEQ ID NO: 123 - protein, 192 aa, Mus musculus
VTARRLNCVKHTYPSGHKCCRECQPGHGMVSRCDHTRDTLCHPCETGFYNEAVNYDTCKQCTQCNHRSGSELKQNCTPTQDTVCRCRPGTQPRQDSGYKLGVDCVPCPPGHFSPGNNQACKPWTNCTLSGKQTRHPASDSLDAVCEDRSLLATLLWETQRPTFRPTTVQSTTVWPRTSELPSPPTLVTPEGP

SEQ ID NO: 124 - DNA, 681 bp, Artificial Sequence
  Nucleotide sequence Fc hole chain
gacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 125 - DNA, 1335 bp, Artificial Sequence
  Nucleotide sequence human OX40 antigen Fc knob chain
ctgcactgcgtgggcgacacctaccccagcaacgaccggtgctgccacgagtgcagacccggcaacggcatggtgtcccggtgcagccggtcccagaacaccgtgtgcagaccttgcggccctggcttctacaacgacgtggtgtccagcaagccctgcaagccttgtacctggtgcaacctgcggagcggcagcgagcggaagcagctgtgtaccgccacccaggataccgtgtgccggtgtagagccggcacccagcccctggacagctacaaacccggcgtggactgcgccccttgccctcctggccacttcagccctggcgacaaccaggcctgcaagccttggaccaactgcaccctggccggcaagcacaccctgcagcccgccagcaatagcagcgacgccatctgcgaggaccgggatcctcctgccacccagcctcaggaaacccagggccctcccgccagacccatcaccgtgcagcctacagaggcctggcccagaaccagccaggggcctagcaccagacccgtggaagtgcctggcggcagagccgtcgacgaacagttatattttcagggcggctcacccaaatctgcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcctgaacgacatcttcgaggcccagaagattgaatggcacgag

SEQ ID NO: 126 - DNA, 1335 bp, Artificial Sequence
  Nucleotide sequence cynomolgus OX40 antigen Fc knob chain
ctccactgtgtcggggacacctaccccagcaacgaccggtgctgtcaggagtgcaggccaggcaacgggatggtgagccgctgcaaccgctcccagaacacggtgtgccgtccgtgcgggcccggcttctacaacgacgtggtcagcgccaagccctgcaaggcctgcacatggtgcaacctcagaagtgggagtgagcggaaacagccgtgcacggccacacaggacacagtctgccgctgccgggcgggcacccagcccctggacagctacaagcctggagttgactgtgccccctgccctccagggcacttctccccgggcgacaaccaggcctgcaagccctggaccaactgcaccttggccgggaagcacaccctgcagccagccagcaatagctcggacgccatctgtgaggacagggaccccccacccacacagccccaggagacccagggccccccggccaggcccaccactgtccagcccactgaagcctggcccagaacctcacagagaccctccacccggcccgtggaggtccccaggggccctgcggtcgacgaacagttatattttcagggcggctcacccaaatctgcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcctgaacgacatcttcgaggcccagaagattgaatggcacgag

SEQ ID NO: 127 - DNA, 1353 bp, Artificial Sequence
  Nucleotide sequence murine OX40 antigen Fc knob chain
gtgaccgccagacggctgaactgcgtgaagcacacctaccccagcggccacaagtgctgcagagagtgccagcccggccacggcatggtgtccagatgcgaccacacacgggacaccctgtgccacccttgcgagacaggcttctacaacgaggccgtgaactacgatacctgcaagcagtgcacccagtgcaaccacagaagcggcagcgagctgaagcagaactgcacccccacccaggataccgtgtgcagatgcagacccggcacccagcccagacaggacagcggctacaagctgggcgtggactgcgtgccctgccctcctggccacttcagccccggcaacaaccaggcctgcaagccctggaccaactgcaccctgagcggcaagcagaccagacaccccgccagcgacagcctggatgccgtgtgcgaggacagaagcctgctggccaccctgctgtgggagacacagcggcccaccttcagacccaccaccgtgcagagcaccaccgtgtggcccagaaccagcgagctgcccagtcctcctaccctcgtgacacctgagggccccgtcgacgaacagttatattttcagggcggctcacccaaatctgcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcctgaacgacatcttcgaggcccagaagattgaatggcacgag

SEQ ID NO: 128 - protein, 227 aa, Artificial Sequence
  Fc hole chain
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 129 - protein, 445 aa, Artificial Sequence
  human OX40 antigen Fc knob chain
LHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 130 - protein, 445 aa, Artificial Sequence
  cynomolgus OX40 antigen Fc knob chain
LHCVGDTYPSNDRCCQECRPGNGMVSRCNRSQNTVCRPCGPGFYNDVVSAKPCKACTWCNLRSGSERKQPCTATQDTVCRCRAGTQPLDSYKPGVDCAPCPPGHFSPGDNQACKPWTNCTLAGKHTLQPASNSSDAICEDRDPPPTQPQETQGPPARPTTVQPTEAWPRTSQRPSTRPVEVPRGPAVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 131 - protein, 451 aa, Artificial Sequence
  murine OX40 antigen Fc knob chain
VTARRLNCVKHTYPSGHKCCRECQPGHGMVSRCDHTRDTLCHPCETGFYNEAVNYDTCKQCTQCNHRSGSELKQNCTPTQDTVCRCRPGTQPRQDSGYKLGVDCVPCPPGHFSPGNNQACKPWTNCTLSGKQTRHPASDSLDAVCEDRSLLATLLWETQRPTFRPTTVQSTTVWPRTSELPSPPTLVTPEGPVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 132 - DNA, 1613 bp, Artificial Sequence
  nucleotide sequence of library DP88-4
tgaaatacctattgcctacggcagccgctggattgttattactcgcggcccagccggccatggccgacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagtataatagttattctacgtttggccagggcaccaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgtggagccgcagaacaaaaactcatctcagaagaggatctgaatggagccgcagactacaaggacgacgacgacaagggtgccgcataataaggcgcgccaattctatttcaaggagacagtcatatgaaatacctgctgccgaccgctgctgctggtctgctgctcctcgctgcccagccggcgatggcccaggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagactatccccaggcggttactatgttatggatgcctggggccaagggaccaccgtgaccgtctcctcagctagcaccaaaggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaagtggacaagaaagttgagcccaaatcttgtgacgcggccgcaagcactagtgcccatcaccatcaccatcacgccgcggca

SEQ ID NO: 133 - DNA, 723 bp, Artificial Sequence
  nucleotide sequence of Fab light chain Vk1_5
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagtataatagttattctacgtttggccagggcaccaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgtggagccgcagaacaaaaactcatctcagaagaggatctgaatggagccgcagactacaaggacgacgacgacaagggtgccgca

SEQ ID NO: 134 - protein, 241 aa, Artificial Sequence
  Fab light chain Vk1_5
DIQMTQSPSTLSASVGDRVTITCRASQSISSWLAWYQQKPGKAPKLLIYDASSLESGVPSRFSGSGSGTEFTLTISSLQPDDFATYYCQQYNSYSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGAAEQKLISEEDLNGAADYKDDDDKGAA

SEQ ID NO: 135 - DNA, 720 bp, Artificial Sequence
  nucleotide sequence of Fab heavy chain VH1_69
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagactatccccaggcggttactatgttatggatgcctggggccaagggaccaccgtgaccgtctcctcagctagcaccaaaggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaagtggacaagaaagttgagcccaaatcttgtgacgcggccgcaagcactagtgcccatcaccatcaccatcacgccgcggca

SEQ ID NO: 136 - protein, 240 aa, Artificial Sequence
  Fab heavy chain VH1_69
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARLSPGGYYVMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDAAASTSAHHHHHHAAA

SEQ ID NO: 137 - DNA, 26 bp, Artificial Sequence
  LMB3 Primer
caggaaacagctatgaccatgattac

SEQ ID NO: 138 - DNA, 71 bp, Artificial Sequence
  Vk1_5_L3r_S Primer
ctcgactttggtgccctggccaaacgtsbaatacgaattatactgttggcagtaataagttgcaaaatcat

SEQ ID NO: 139 - DNA, 74 bp, Artificial Sequence
  Vk1_5_L3r_SY Primer
ctcgactttggtgccctggccaaacgtmhrsgratacgaattatactgttggcagtaataagttgcaaaatcat

SEQ ID NO: 140 - DNA, 77 bp, Artificial Sequence
  Vk1_5_L3r_SPY
ctcgactttggtgccctggccaaacgtmhhmsssgratacgaattatactgttggcagtaataagttgcaaaatcat

SEQ ID NO: 141 - DNA, 27 bp, Artificial Sequence
  RJH31 Primer
acgtttggccagggcaccaaagtcgag

SEQ ID NO: 142 - DNA, 28 bp, Artificial Sequence
  RJH32 Primer
tctcgcacagtaatacacggcggtgtcc

SEQ ID NO: 143 - DNA, 64 bp, Artificial Sequence
  DP88-v4-4
ggacaccgccgtgtattactgtgcgagagactactggggccaagggaccaccgtgaccgtctcc

SEQ ID NO: 144 - DNA, 64 bp, Artificial Sequence; identical to SEQ ID NO: 143
  DP88-v4-6

SEQ ID NO: 145 - DNA, 64 bp, Artificial Sequence; identical to SEQ ID NO: 143
  DP88-v4-8

SEQ ID NO: 146 - DNA, 30 bp, Artificial Sequence
  fdseqlong Primer
gacgttagtaaatgaattttctgtatgagg

SEQ ID NO: 147 - DNA, 1596 bp, Artificial Sequence
  (Vk3_20/VH3_23) template
atgaaatacctattgcctacggcagccgctggattgttattactcgcggcccagccggccatggccgaaatcgtgttaacgcagtctccaggcaccctgtctttgtctccaggggaaagagccaccctctcttgcagggccagtcagagtgttagcagcagctacttagcctggtaccagcagaaacctggccaggctcccaggctcctcatctatggagcatccagcagggccactggcatcccagacaggttcagtggcagtggatccgggacagacttcactctcaccatcagcagactggagcctgaagattttgcagtgtattactgtcagcagtatggtagctcaccgctgacgttcggccaggggaccaaagtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgtggagccgcacatcaccatcaccatcacggagccgcagactacaaggacgacgacgacaagggtgccgcataataaggcgcgccaattctatttcaaggagacagtcatatgaaatacctgctgccgaccgctgctgctggtctgctgctcctcgctgcccagccggcgatggccgaggtgcaattgctggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaccgtttccgtattttgactactggggccaaggaaccctggtcaccgtctcgagtgctagcaccaaaggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaagtggacaagaaagttgagcccaaatcttgtgacgcggccgcagaacaaaaactcatctcagaagaggatctgaatgccgcggca

SEQ ID NO: 148 - DNA, 714 bp, Artificial Sequence
  Fab light chain Vk3_20
gaaatcgtgttaacgcagtctccaggcaccctgtctttgtctccaggggaaagagccaccctctcttgcagggccagtcagagtgttagcagcagctacttagcctggtaccagcagaaacctggccaggctcccaggctcctcatctatggagcatccagcagggccactggcatcccagacaggttcagtggcagtggatccgggacagacttcactctcaccatcagcagactggagcctgaagattttgcagtgtattactgtcagcagtatggtagctcaccgctgacgttcggccaggggaccaaagtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgtggagccgcacatcaccatcaccatcacggagccgcagactacaaggacgacgacgacaagggtgccgca

SEQ ID NO: 149 - protein, 238 aa, Artificial Sequence
  Fab light chain Vk3_20
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGAAHHHHHHGAADYKDDDDKGAA

SEQ ID NO: 150 - DNA, 711 bp, Artificial Sequence
  Fab heavy chain VH3_23
gaggtgcaattgctggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaccgtttccgtattttgactactggggccaaggaaccctggtcaccgtctcgagtgctagcaccaaaggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaagtggacaagaaagttgagcccaaatcttgtgacgcggccgcagaacaaaaactcatctcagaagaggatctgaatgccgcggca

SEQ ID NO: 151 - protein, 237 aa, Artificial Sequence
  Fab heavy chain VH3_23 (DP47)
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKPFPYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDAAAEQKLISEEDLNAAA

SEQ ID NO: 152 - DNA, 25 bp, Artificial Sequence
  MS64 Primer
acgttcggccaggggaccaaagtgg

SEQ ID NO: 153 - DNA, 25 bp, Artificial Sequence
  DP47CDR3_ba Primer
cgcacagtaatatacggccgtgtcc

SEQ ID NO: 154 - DNA, 64 bp, Artificial Sequence
  DP47-v4-4
cgaggacacggccgtatattactgtgcggactactggggccaaggaaccctggtcaccgtctcg

SEQ ID NO: 155 - DNA, 64 bp, Artificial Sequence; identical to SEQ ID NO: 154
  DP47-v4-6

SEQ ID NO: 156 - DNA, 64 bp, Artificial Sequence; identical to SEQ ID NO: 154
  DP47-v4-8

SEQ ID NO: 157 - DNA, 30 bp, Artificial Sequence; identical to SEQ ID NO: 146
  fdseqlong

SEQ ID NO: 158 - DNA, 1605 bp, Artificial Sequence
  Vl3_19/VH3_23 library template
atgaaatacctattgcctacggcagccgctggattgttattactcgcggcccagccggccatggcctcgtctgagctgactcaggaccctgctgtgtctgtggccttgggacagacagtcaggatcacatgccaaggagacagcctcagaagttattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgtgatagtagcggtaatcatgtggtattcggcggagggaccaagctgaccgtcctaggacaacccaaggctgcccccagcgtgaccctgttcccccccagcagcgaggaattgcaggccaacaaggccaccctggtctgcctgatcagcgacttctacccaggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaggtcctacagctgccaggtgacccacgagggcagcaccgtggagaaaaccgtggcccccaccgagtgcagcggagccgcagaacaaaaactcatctcagaagaggatctgaatggagccgcagactacaaggacgacgacgacaagggtgccgcataataaggcgcgccaattctatttcaaggagacagtcatatgaaatacctgctgccgaccgctgctgctggtctgctgctcctcgctgcccagccggcgatggccgaggtgcaattgctggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaccgtttccgtattttgactactggggccaaggaaccctggtcaccgtctcgagtgctagcaccaaaggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaagtggacaagaaagttgagcccaaatcttgtgacgcggccgcaagcactagtgcccatcaccatcaccatcacgccgcggca

SEQ ID NO: 159 - DNA, 726 bp, Artificial Sequence
  Fab light chain Vl3_19
tcgtctgagctgactcaggaccctgctgtgtctgtggccttgggacagacagtcaggatcacatgccaaggagacagcctcagaagttattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgtgatagtagcggtaatcatgtggtattcggcggagggaccaagctgaccgtcctaggacaacccaaggctgcccccagcgtgaccctgttcccccccagcagcgaggaattgcaggccaacaaggccaccctggtctgcctgatcagcgacttctacccaggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaggtcctacagctgccaggtgacccacgagggcagcaccgtggagaaaaccgtggcccccaccgagtgcagcggagccgcagaacaaaaactcatctcagaagaggatctgaatggagccgcagactacaaggacgacgacgacaagggtgccgca

SEQ ID NO: 160 - protein, 242 aa, Artificial Sequence
  Fab light chain Vl3_19
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSGAAEQKLISEEDLNGAADYKDDDDKGAA

SEQ ID NO: 161 - DNA, 26 bp, Artificial Sequence
  LMB3 lambda-DP47 library
caggaaacagctatgaccatgattac

SEQ ID NO: 162 - DNA, 85 bp, Artificial Sequence
  Vl_3_19_L3r_V lambda-DP47 library
ggacggtcagcttggtccctccgccgaatacvhvattaccgctactatcacgggagttacagtaatagtcagcctcatcttccgc

SEQ ID NO: 163 - DNA, 88 bp, Artificial Sequence
  Vl_3_19_L3r_HV lambda-DP47
ggacggtcagcttggtccctccgccgaataccmmatgattaccgctactatcacgggagttacagtaatagtcagcctcatcttccgc

SEQ ID NO: 164 - DNA, 91 bp, Artificial Sequence
  Vl_3_19_L3r_HLV lambda-DP47
ggacggtcagcttggtccctccgccgaatacrhmvwgatgattaccgctactatcacgggagttacagtaatagtcagcctcatcttccgc

SEQ ID NO: 165 - DNA, 28 bp, Artificial Sequence
  RJH80 lambda-DP47
ttcggcggagggaccaagctgaccgtcc

SEQ ID NO: 166 - DNA, 318 bp, Artificial Sequence
  DNA (8H9 ) VL
tcgtctgagctgactcaggaccctgctgtgtctgtggccttgggacagacagtcaggatcacatgccaaggagacagcctcagaagttattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgtgttatgcctcataatcgcgtattcggcggagggaccaagctgaccgtc

SEQ ID NO: 167 - DNA, 360 bp, Artificial Sequence
  DNA (8H9) VH
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgcgtgttttctaccgtggtggtgtttctatggactactggggccaaggaaccctggtcaccgtctcgagt

SEQ ID NO: 168 - DNA, 321 bp, Artificial  Sequence
  DNA (49B4) VL
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagtatagttcgcagccgtatacgtttggccagggcaccaaagtcgagatcaag

SEQ ID NO: 169 - DNA, 354 bp, Artificial Sequence
  DNA (49B4) VH
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatactaccgtggtccgtacgactactggggccaagggaccaccgtgaccgtctcctca

SEQ ID NO: 170 - DNA, 324 bp, Artificial Sequence
  DNA (1G4) VL
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagtatatttcgtattccatgttgacgtttggccagggcaccaaagtcgagatcaag

SEQ ID NO: 171 - DNA, 348 bp, Artificial Sequence
  DNA (1G4) VH
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatacggttctatggactactggggccaagggaccaccgtgaccgtctcctca

SEQ ID NO: 172 - DNA, 321 bp, Artificial Sequence
  DNA (20B7) VL
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagtatcaggctttttcgcttacgtttggccagggcaccaaagtcgagatcaag

SEQ ID NO: 173 - DNA, 366 bp, Artificial Sequence
  DNA (20B7) VH
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagttaactacccgtactcttactggggtgacttcgactactggggccaagggaccaccgtgaccgtctcctca

SEQ ID NO: 174 - DNA, 324 bp, Artificial Sequence
  DNA (CLC-563) VL
gagatcgtgctgacccagagccccggcacactctccctgtctcctggggaaagggccaccctttcatgcagagccagccagtccgtctctagtagctacctggcatggtatcagcagaagccaggacaagccccccgcctcctgatttacggcgcttcctctcgggcaactggtatccctgacaggttctcagggagcggaagcggaacagattttaccttgactatttctagactggagccagaggacttcgccgtgtattactgtcagcagtacggtagtagccccctcacctttggccaggggacaaaagtcgaaatcaag

SEQ ID NO: 175 - DNA, 348 bp, Artificial Sequence
  DNA (CLC-563) VH
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgcttgacgttggtgctttcgactactggggccaaggagccctggtcaccgtctcgagt

SEQ ID NO: 176 - DNA, 324 bp, Artificial Sequence; identical to SEQ ID NO: 174
  DNA (CLC-564) VL

SEQ ID NO: 177 - DNA, 348 bp, Artificial Sequence
  DNA (CLC-564) VH
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgttcgacgttggtccgttcgactactggggccaaggaaccctggtcaccgtctcgagt

SEQ ID NO: 178 - DNA, 318 bp, Artificial Sequence; identical to SEQ ID NO: 166
  DNA (17A9) VL

SEQ ID NO: 179 - DNA, 360 bp, Artificial Sequence; identical to SEQ ID NO: 167
  DNA (17A9) VH

SEQ ID NO: 180 - DNA, 645 bp, Artificial Sequence
  DNA 8H9 P329GLALA IgG1 light chain
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagtatttgacgtattcgcggtttacgtttggccagggcaccaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 181 - DNA, 1338 bp, Artificial Sequence
  DNA 8H9 P329GLALA IgG1 heavy chain
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatacggttggatggactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 182 - protein, 215 aa, Artificial Sequence
  8H9 P329GLALA IgG1 light chain
DIQMTQSPSTLSASVGDRVTITCRASQSISSWLAWYQQKPGKAPKLLIYDASSLESGVPSRFSGSGSGTEFTLTISSLQPDDFATYYCQQYLTYSRFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 183 - protein, 446 aa, Artificial Sequence
  8H9 P329GLALA IgG1 Heavy chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYGWMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 184 - DNA, 642 bp, Artificial Sequence
  DNA 49B4 P329GLALA IgG1 light chain
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagtatagttcgcagccgtatacgtttggccagggcaccaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 185 - DNA, 1344 bp, Artificial Sequence
  DNA 49B4 P329GLALA IgG1 heavy chain
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatactaccgtggtccgtacgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 186 - protein, 214 aa, Artificial Sequence
  49B4 P329GLALA IgG1 light chain
DIQMTQSPSTLSASVGDRVTITCRASQSISSWLAWYQQKPGKAPKLLIYDASSLESGVPSRFSGSGSGTEFTLTISSLQPDDFATYYCQQYSSQPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 187 - protein, 448 aa, Artificial Sequence
  49B4 heavy chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYRGPYDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 188 - DNA, 645 bp, Artificial Sequence
  DNA 1G4 P329GLALA IgG1 light chain
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagtatatttcgtattccatgttgacgtttggccagggcaccaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 189 - DNA, 1338 bp, Artificial Sequence
  DNA 1G4 P329GLALA IgG1 heavy chain
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatacggttctatggactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 190 - protein, 215 aa, Artificial Sequence
  1G4 P329GLALA IgG1 light chain
DIQMTQSPSTLSASVGDRVTITCRASQSISSWLAWYQQKPGKAPKLLIYDASSLESGVPSRFSGSGSGTEFTLTISSLQPDDFATYYCQQYISYSMLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 191 - protein, 446 aa, Artificial Sequence
  1G4 P329GLALA IgG1 heavy chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYGSMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 192 - DNA, 642 bp, Artificial sequence
  DNA 20B7 P329GLALA IgG1 light chain
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagtatcaggctttttcgcttacgtttggccagggcaccaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 193 - DNA, 1356 bp, Artificial Sequence
  DNA 20B7 P329GLALA IgG1 heavy chain
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagttaactacccgtactcttactggggtgacttcgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 194 - protein, 214 aa, Artificial
  20B7 P329GLALA IgG1 Light chain
DIQMTQSPSTLSASVGDRVTITCRASQSISSWLAWYQQKPGKAPKLLIYDASSLESGVPSRFSGSGSGTEFTLTISSLQPDDFATYYCQQYQAFSLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 195 - protein, 452 aa, Artificial
  20B7 P329GLALA IgG1 heavy chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARVNYPYSYWGDFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 196 - DNA, 645 bp, Artificial
  DNA CLC-563 P329GLALA IgG1 light chain
gagatcgtgctgacccagagccccggcacactctccctgtctcctggggaaagggccaccctttcatgcagagccagccagtccgtctctagtagctacctggcatggtatcagcagaagccaggacaagccccccgcctcctgatttacggcgcttcctctcgggcaactggtatccctgacaggttctcagggagcggaagcggaacagattttaccttgactatttctagactggagccagaggacttcgccgtgtattactgtcagcagtacggtagtagccccctcacctttggccaggggacaaaagtcgaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 197 - DNA, 1338 bp, Artificial
  DNA CLC-563 P329GLALA IgG1 heavy chain
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgcttgacgttggtgctttcgactactggggccaaggagccctggtcaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 198 - protein, 215 aa, Artificial
  CLC-563 P329GLALA IgG1 light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 199 - protein, 446 aa, Artificial
  CLC-563 P329GLALA IgG1 heavy chain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCALDVGAFDYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - DNA, 645 bp, Artificial; identical to SEQ ID NO: 196
  DNA CLC-564 P329GLALA IgG1 light chain

SEQ ID NO: 201 - DNA, 1338 bp, Artificial
  DNA CLC-564 P329GLALA IgG1 heavy chain
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgttcgacgttggtccgttcgactactggggccaaggaaccctggtcaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 202 - protein, 215 aa, Artificial; identical to SEQ ID NO: 198
  CLC-564 P329GLALA IgG1 light chain

SEQ ID NO: 203 - protein, 446 aa, Artificial
  CLC-564 P329GLALA IgG1 heavy chain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAFDVGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204 - DNA, 639 bp, Artificial
  DNA 17A9 P329GLALA IgG1 light chain
tcgtctgagctgactcaggaccctgctgtgtctgtggccttgggacagacagtcaggatcacatgccaaggagacagcctcagaagttattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgtgttatgcctcataatcgcgtattcggcggagggaccaagctgaccgtcctaggtcaacccaaggctgcccccagcgtgaccctgttcccccccagcagcgaggaactgcaggccaacaaggccaccctggtctgcctgatcagcgacttctacccaggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaggtcctacagctgccaggtgacccacgagggcagcaccgtggagaaaaccgtggcccccaccgagtgcagc

SEQ ID NO: 205 - DNA, 1350 bp, Artificial
  DNA 17A9 P329GLALA IgG1 heavy chain
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgcgtgttttctaccgtggtggtgtttctatggactactggggccaaggaaccctggtcaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 206 - protein, 213 aa, Artificial
  17A9 P329GLALA IgG1 light chain
SSELTQDPAVSVALGQTVRITCQGDSLRSYYASWYQQKPGQAPVLVIYGKNNRPSGIPDRFSGSSSGNTASLTITGAQAEDEADYYCNSRVMPHNRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 207 - protein, 450 aa, Artificial
  17A9 P329GLALA IgG1 heavy chain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARVFYRGGVSMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 208 - DNA, 663 bp, Artificial Sequence
  human OX40 His nucleotide sequence
ctgcactgcgtgggcgacacctaccccagcaacgaccggtgctgccacgagtgcagacccggcaacggcatggtgtcccggtgcagccggtcccagaacaccgtgtgcagaccttgcggccctggcttctacaacgacgtggtgtccagcaagccctgcaagccttgtacctggtgcaacctgcggagcggcagcgagcggaagcagctgtgtaccgccacccaggataccgtgtgccggtgtagagccggcacccagcccctggacagctacaaacccggcgtggactgcgccccttgccctcctggccacttcagccctggcgacaaccaggcctgcaagccttggaccaactgcaccctggccggcaagcacaccctgcagcccgccagcaatagcagcgacgccatctgcgaggaccgggatcctcctgccacccagcctcaggaaacccagggccctcccgccagacccatcaccgtgcagcctacagaggcctggcccagaaccagccaggggcctagcaccagacccgtggaagtgcctggcggcagagccgtcgacgaacagttatattttcagggcggctcaggcctgaacgacatcttcgaggcccagaagatcgagtggcacgaggctcgagctcaccaccatcaccatcac

SEQ ID NO: 209 - protein, 221 aa, Artificial Sequence
  human OX40 His
LHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVDEQLYFQGGSGLNDIFEAQKIEWHEARAHHHHHH

SEQ ID NO: 210 - DNA, 681 bp, Artificial Sequence
  DNA murine OX40 His
gtgaccgccagacggctgaactgcgtgaagcacacctaccccagcggccacaagtgctgcagagagtgccagcccggccacggcatggtgtccagatgcgaccacacacgggacaccctgtgccacccttgcgagacaggcttctacaacgaggccgtgaactacgatacctgcaagcagtgcacccagtgcaaccacagaagcggcagcgagctgaagcagaactgcacccccacccaggataccgtgtgcagatgcagacccggcacccagcccagacaggacagcggctacaagctgggcgtggactgcgtgccctgccctcctggccacttcagccccggcaacaaccaggcctgcaagccctggaccaactgcaccctgagcggcaagcagaccagacaccccgccagcgacagcctggatgccgtgtgcgaggacagaagcctgctggccaccctgctgtgggagacacagcggcccaccttcagacccaccaccgtgcagagcaccaccgtgtggcccagaaccagcgagctgcccagtcctcctaccctcgtgacacctgagggccccgtcgacgaacagttatattttcagggcggctcaggcctgaacgacatcttcgaggcccagaagatcgagtggcacgaggctcgagctcaccaccatcaccatcac

SEQ ID NO: 211 - protein, 226 aa, Artificial Sequence
  murine OX40 His
TARRLNCVKHTYPSGHKCCRECQPGHGMVSRCDHTRDTLCHPCETGFYNEAVNYDTCKQCTQCNHRSGSELKQNCTPTQDTVCRCRPGTQPRQDSGYKLGVDCVPCPPGHFSPGNNQACKPWTNCTLSGKQTRHPASDSLDAVCEDRSLLATLLWETQRPTFRPTTVQSTTVWPRTSELPSPPTLVTPEGPVDEQLYFQGGSGLNDIFEAQKIEWHEARAHHHHHH

SEQ ID NO: 212 - DNA, 1317 bp, Artificial Sequence
  Nucleotide sequence dimeric human OX40 antigen Fc
ctgcactgcgtgggcgacacctaccccagcaacgaccggtgctgccacgagtgcagacccggcaacggcatggtgtcccggtgcagccggtcccagaacaccgtgtgcagaccttgcggccctggcttctacaacgacgtggtgtccagcaagccctgcaagccttgtacctggtgcaacctgcggagcggcagcgagcggaagcagctgtgtaccgccacccaggataccgtgtgccggtgtagagccggcacccagcccctggacagctacaaacccggcgtggactgcgccccttgccctcctggccacttcagccctggcgacaaccaggcctgcaagccttggaccaactgcaccctggccggcaagcacaccctgcagcccgccagcaatagcagcgacgccatctgcgaggaccgggatcctcctgccacccagcctcaggaaacccagggccctcccgccagacccatcaccgtgcagcctacagaggcctggcccagaaccagccaggggcctagcaccagacccgtggaagtgcctggcggcagagccgtcgacgaacagttatattttcagggcggctcacccaaatctgcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggctacccatacgatgttccagattacgct

SEQ ID NO: 213 - protein, 439 aa, Artificial Sequence
  dimeric human OX40 antigen Fc
LHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGYPYDVPDYA

SEQ ID NO: 214 - DNA, 2064 bp, Artificial Sequence
  (8B9) VHCH1-Heavy chain-(28H1) VHCL
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatacggttggatggactactggggccaagggaccaccgtgaccgtctcctcagctagcaccaagggcccatccgtgttccctctggccccttccagcaagtctacctctggcggcacagccgctctgggctgcctcgtgaaggactacttccccgagcctgtgacagtgtcctggaactctggcgccctgacatccggcgtgcacacctttccagctgtgctgcagtcctccggcctgtactccctgtcctccgtcgtgacagtgccctccagctctctgggcacccagacctacatctgcaacgtgaaccacaagccctccaacaccaaggtggacaagaaggtggaacccaagtcctgcgacaagacccacacctgtcccccttgtcctgcccctgaagctgctggcggccctagcgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaatgccaagaccaagcctagagaggaacagtacaactccacctaccgggtggtgtccgtgctgaccgtgctgcaccaggattggctgaacggcaaagagtacaagtgcaaggtgtccaacaaggccctgggagcccccatcgaaaagaccatctccaaggccaagggccagcctcgcgagcctcaggtgtacaccctgccccctagcagagatgagctgaccaagaaccaggtgtccctgacctgtctcgtgaaaggcttctacccctccgatatcgccgtggaatgggagagcaacggccagcccgagaacaactacaagaccaccccccctgtgctggactccgacggctcattcttcctgtactctaagctgacagtggacaagtcccggtggcagcagggcaacgtgttctcctgctccgtgatgcacgaggccctgcacaaccactacacccagaagtccctgtccctgtctcccgggggaggcggaggatctggcggaggcggatccggtggtggcggatctgggggcggtggatctgaggtgcagctgctggaatctgggggaggactggtgcagccaggcggatctctgaggctgtcctgcgctgcttccggctttaccttctccagccacgccatgagttgggtgcgccaggcacccggaaaaggactggaatgggtgtcagccatctgggcctccggcgagcagtactacgccgatagcgtgaagggccggttcaccatctctcgggataacagcaagaatactctgtacctgcagatgaactccctgcgcgctgaagataccgctgtgtattactgcgccaagggctggctgggcaacttcgattactggggccagggaaccctcgtgactgtctcgagcgcttctgtggccgctccctccgtgttcatcttcccaccttccgacgagcagctgaagtccggcactgcctctgtcgtgtgcctgctgaacaacttctaccctcgggaagccaaggtgcagtggaaagtggataacgccctgcagtccggcaactcccaggaatccgtgaccgagcaggactccaaggacagcacctactccctgagcagcaccctgaccctgtccaaggccgactacgagaagcacaaggtgtacgcctgtgaagtgacccaccagggcctgtccagccccgtgaccaagtccttcaaccggggcgagtgc

SEQ ID NO: 215 - DNA, 642 bp, Artificial Sequence
  DNA VLCH1-Light chain 2 (28H1)
gagatcgtgctgacccagtctcccggcaccctgagcctgagccctggcgagagagccaccctgagctgcagagccagccagagcgtgagccggagctacctggcctggtatcagcagaagcccggccaggcccccagactgctgatcatcggcgccagcacccgggccaccggcatccccgatagattcagcggcagcggctccggcaccgacttcaccctgaccatcagccggctggaacccgaggacttcgccgtgtactactgccagcagggccaggtgatcccccccaccttcggccagggcaccaaggtggaaatcaagagctccgctagcaccaagggcccctccgtgtttcctctggcccccagcagcaagagcacctctggcggaacagccgccctgggctgcctggtgaaagactacttccccgagcccgtgaccgtgtcctggaactctggcgccctgaccagcggcgtgcacacctttccagccgtgctgcagagcagcggcctgtactccctgagcagcgtggtgacagtgccctccagcagcctgggcacccagacctacatctgcaacgtgaaccacaagcccagcaacaccaaagtggacaagaaggtggaacccaagagctgcgac

SEQ ID NO: 216 - protein, 688 aa, Artificial Sequence
  (8B9) VHCH1-Heavy chain-(28H1) VHCL
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYGWMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 217 - protein, 214 aa, Artificial Sequence
  VLCH1-Light chain 2 (28H1)
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 218 - DNA, 2070 bp, Artificial Sequence
  DNA (49B4) VHCH1-Heavy chain-(28H1) VHCL
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatactaccgtggtccgtacgactactggggccaagggaccaccgtgaccgtctcctcagctagcaccaagggcccatccgtgttccctctggccccttccagcaagtctacctctggcggcacagccgctctgggctgcctcgtgaaggactacttccccgagcctgtgacagtgtcctggaactctggcgccctgacatccggcgtgcacacctttccagctgtgctgcagtcctccggcctgtactccctgtcctccgtcgtgacagtgccctccagctctctgggcacccagacctacatctgcaacgtgaaccacaagccctccaacaccaaggtggacaagaaggtggaacccaagtcctgcgacaagacccacacctgtcccccttgtcctgcccctgaagctgctggcggccctagcgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaatgccaagaccaagcctagagaggaacagtacaactccacctaccgggtggtgtccgtgctgaccgtgctgcaccaggattggctgaacggcaaagagtacaagtgcaaggtgtccaacaaggccctgggagcccccatcgaaaagaccatctccaaggccaagggccagcctcgcgagcctcaggtgtacaccctgccccctagcagagatgagctgaccaagaaccaggtgtccctgacctgtctcgtgaaaggcttctacccctccgatatcgccgtggaatgggagagcaacggccagcccgagaacaactacaagaccaccccccctgtgctggactccgacggctcattcttcctgtactctaagctgacagtggacaagtcccggtggcagcagggcaacgtgttctcctgctccgtgatgcacgaggccctgcacaaccactacacccagaagtccctgtccctgtctcccgggggaggcggaggatctggcggaggcggatccggtggtggcggatctgggggcggtggatctgaggtgcagctgctggaatctgggggaggactggtgcagccaggcggatctctgaggctgtcctgcgctgcttccggctttaccttctccagccacgccatgagttgggtgcgccaggcacccggaaaaggactggaatgggtgtcagccatctgggcctccggcgagcagtactacgccgatagcgtgaagggccggttcaccatctctcgggataacagcaagaatactctgtacctgcagatgaactccctgcgcgctgaagataccgctgtgtattactgcgccaagggctggctgggcaacttcgattactggggccagggaaccctcgtgactgtctcgagcgcttctgtggccgctccctccgtgttcatcttcccaccttccgacgagcagctgaagtccggcactgcctctgtcgtgtgcctgctgaacaacttctaccctcgggaagccaaggtgcagtggaaagtggataacgccctgcagtccggcaactcccaggaatccgtgaccgagcaggactccaaggacagcacctactccctgagcagcaccctgaccctgtccaaggccgactacgagaagcacaaggtgtacgcctgtgaagtgacccaccagggcctgtccagccccgtgaccaagtccttcaaccggggcgagtgc

SEQ ID NO: 219 - protein, 690 aa, Artificial Sequence
  (49B4) VHCH1-Heavy chain-(28H1) VHCL
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYRGPYDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 220 - DNA, 2064 bp, Artificial Sequence
  DNA (1G4) VHCH1-Heavy chain-(28H1) VHCL
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatacggttctatggactactggggccaagggaccaccgtgaccgtctcctcagctagcaccaagggcccatccgtgttccctctggccccttccagcaagtctacctctggcggcacagccgctctgggctgcctcgtgaaggactacttccccgagcctgtgacagtgtcctggaactctggcgccctgacatccggcgtgcacacctttccagctgtgctgcagtcctccggcctgtactccctgtcctccgtcgtgacagtgccctccagctctctgggcacccagacctacatctgcaacgtgaaccacaagccctccaacaccaaggtggacaagaaggtggaacccaagtcctgcgacaagacccacacctgtcccccttgtcctgcccctgaagctgctggcggccctagcgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaatgccaagaccaagcctagagaggaacagtacaactccacctaccgggtggtgtccgtgctgaccgtgctgcaccaggattggctgaacggcaaagagtacaagtgcaaggtgtccaacaaggccctgggagcccccatcgaaaagaccatctccaaggccaagggccagcctcgcgagcctcaggtgtacaccctgccccctagcagagatgagctgaccaagaaccaggtgtccctgacctgtctcgtgaaaggcttctacccctccgatatcgccgtggaatgggagagcaacggccagcccgagaacaactacaagaccaccccccctgtgctggactccgacggctcattcttcctgtactctaagctgacagtggacaagtcccggtggcagcagggcaacgtgttctcctgctccgtgatgcacgaggccctgcacaaccactacacccagaagtccctgtccctgtctcccgggggaggcggaggatctggcggaggcggatccggtggtggcggatctgggggcggtggatctgaggtgcagctgctggaatctgggggaggactggtgcagccaggcggatctctgaggctgtcctgcgctgcttccggctttaccttctccagccacgccatgagttgggtgcgccaggcacccggaaaaggactggaatgggtgtcagccatctgggcctccggcgagcagtactacgccgatagcgtgaagggccggttcaccatctctcgggataacagcaagaatactctgtacctgcagatgaactccctgcgcgctgaagataccgctgtgtattactgcgccaagggctggctgggcaacttcgattactggggccagggaaccctcgtgactgtctcgagcgcttctgtggccgctccctccgtgttcatcttcccaccttccgacgagcagctgaagtccggcactgcctctgtcgtgtgcctgctgaacaacttctaccctcgggaagccaaggtgcagtggaaagtggataacgccctgcagtccggcaactcccaggaatccgtgaccgagcaggactccaaggacagcacctactccctgagcagcaccctgaccctgtccaaggccgactacgagaagcacaaggtgtacgcctgtgaagtgacccaccagggcctgtccagccccgtgaccaagtccttcaaccggggcgagtgc

SEQ ID NO: 221 - protein, 688 aa, Artificial Sequence
  (1G4) VHCH1-Heavy chain-(28H1) VHCL
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYGSMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - DNA, 2082 bp, Artificial Sequence
  DNA (20B7) VHCH1-Heavy chain-(28H1) VHCL
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagttaactacccgtactcttactggggtgacttcgactactggggccaagggaccaccgtgaccgtctcctcagctagcaccaagggcccatccgtgttccctctggccccttccagcaagtctacctctggcggcacagccgctctgggctgcctcgtgaaggactacttccccgagcctgtgacagtgtcctggaactctggcgccctgacatccggcgtgcacacctttccagctgtgctgcagtcctccggcctgtactccctgtcctccgtcgtgacagtgccctccagctctctgggcacccagacctacatctgcaacgtgaaccacaagccctccaacaccaaggtggacaagaaggtggaacccaagtcctgcgacaagacccacacctgtcccccttgtcctgcccctgaagctgctggcggccctagcgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaatgccaagaccaagcctagagaggaacagtacaactccacctaccgggtggtgtccgtgctgaccgtgctgcaccaggattggctgaacggcaaagagtacaagtgcaaggtgtccaacaaggccctgggagcccccatcgaaaagaccatctccaaggccaagggccagcctcgcgagcctcaggtgtacaccctgccccctagcagagatgagctgaccaagaaccaggtgtccctgacctgtctcgtgaaaggcttctacccctccgatatcgccgtggaatgggagagcaacggccagcccgagaacaactacaagaccaccccccctgtgctggactccgacggctcattcttcctgtactctaagctgacagtggacaagtcccggtggcagcagggcaacgtgttctcctgctccgtgatgcacgaggccctgcacaaccactacacccagaagtccctgtccctgtctcccgggggaggcggaggatctggcggaggcggatccggtggtggcggatctgggggcggtggatctgaggtgcagctgctggaatctgggggaggactggtgcagccaggcggatctctgaggctgtcctgcgctgcttccggctttaccttctccagccacgccatgagttgggtgcgccaggcacccggaaaaggactggaatgggtgtcagccatctgggcctccggcgagcagtactacgccgatagcgtgaagggccggttcaccatctctcgggataacagcaagaatactctgtacctgcagatgaactccctgcgcgctgaagataccgctgtgtattactgcgccaagggctggctgggcaacttcgattactggggccagggaaccctcgtgactgtctcgagcgcttctgtggccgctccctccgtgttcatcttcccaccttccgacgagcagctgaagtccggcactgcctctgtcgtgtgcctgctgaacaacttctaccctcgggaagccaaggtgcagtggaaagtggataacgccctgcagtccggcaactcccaggaatccgtgaccgagcaggactccaaggacagcacctactccctgagcagcaccctgaccctgtccaaggccgactacgagaagcacaaggtgtacgcctgtgaagtgacccaccagggcctgtccagccccgtgaccaagtccttcaaccggggcgagtgc

SEQ ID NO: 223 - protein, 694 aa, Artificial Sequence
  (20B7) VHCH1-Heavy chain-(28H1) VHCL
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARVNYPYSYWGDFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 224 - DNA, 2064 bp, Artificial Sequence
  DNA (CLC-563) VHCH1-Heavy chain-(28H1) VHCL
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgcttgacgttggtgctttcgactactggggccaaggagccctggtcaccgtctcgagtgctagcaccaagggcccatccgtgttccctctggccccttccagcaagtctacctctggcggcacagccgctctgggctgcctcgtgaaggactacttccccgagcctgtgacagtgtcctggaactctggcgccctgacatccggcgtgcacacctttccagctgtgctgcagtcctccggcctgtactccctgtcctccgtcgtgacagtgccctccagctctctgggcacccagacctacatctgcaacgtgaaccacaagccctccaacaccaaggtggacaagaaggtggaacccaagtcctgcgacaagacccacacctgtcccccttgtcctgcccctgaagctgctggcggccctagcgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaatgccaagaccaagcctagagaggaacagtacaactccacctaccgggtggtgtccgtgctgaccgtgctgcaccaggattggctgaacggcaaagagtacaagtgcaaggtgtccaacaaggccctgggagcccccatcgaaaagaccatctccaaggccaagggccagcctcgcgagcctcaggtgtacaccctgccccctagcagagatgagctgaccaagaaccaggtgtccctgacctgtctcgtgaaaggcttctacccctccgatatcgccgtggaatgggagagcaacggccagcccgagaacaactacaagaccaccccccctgtgctggactccgacggctcattcttcctgtactctaagctgacagtggacaagtcccggtggcagcagggcaacgtgttctcctgctccgtgatgcacgaggccctgcacaaccactacacccagaagtccctgtccctgtctcccgggggaggcggaggatctggcggaggcggatccggtggtggcggatctgggggcggtggatctgaggtgcagctgctggaatctgggggaggactggtgcagccaggcggatctctgaggctgtcctgcgctgcttccggctttaccttctccagccacgccatgagttgggtgcgccaggcacccggaaaaggactggaatgggtgtcagccatctgggcctccggcgagcagtactacgccgatagcgtgaagggccggttcaccatctctcgggataacagcaagaatactctgtacctgcagatgaactccctgcgcgctgaagataccgctgtgtattactgcgccaagggctggctgggcaacttcgattactggggccagggaaccctcgtgactgtctcgagcgcttctgtggccgctccctccgtgttcatcttcccaccttccgacgagcagctgaagtccggcactgcctctgtcgtgtgcctgctgaacaacttctaccctcgggaagccaaggtgcagtggaaagtggataacgccctgcagtccggcaactcccaggaatccgtgaccgagcaggactccaaggacagcacctactccctgagcagcaccctgaccctgtccaaggccgactacgagaagcacaaggtgtacgcctgtgaagtgacccaccagggcctgtccagccccgtgaccaagtccttcaaccggggcgagtgc

SEQ ID NO: 225 - protein, 688 aa, Artificial Sequence
  (CLC-563) VHCH1-Heavy chain-(28H1) VHCL
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCALDVGAFDYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 226 - DNA, 2064 bp, Artificial Sequence
  DNA (CLC-564) VHCH1-Heavy chain-(28H1) VHCL
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgttcgacgttggtccgttcgactactggggccaaggaaccctggtcaccgtctcgagtgctagcaccaagggcccatccgtgttccctctggccccttccagcaagtctacctctggcggcacagccgctctgggctgcctcgtgaaggactacttccccgagcctgtgacagtgtcctggaactctggcgccctgacatccggcgtgcacacctttccagctgtgctgcagtcctccggcctgtactccctgtcctccgtcgtgacagtgccctccagctctctgggcacccagacctacatctgcaacgtgaaccacaagccctccaacaccaaggtggacaagaaggtggaacccaagtcctgcgacaagacccacacctgtcccccttgtcctgcccctgaagctgctggcggccctagcgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaatgccaagaccaagcctagagaggaacagtacaactccacctaccgggtggtgtccgtgctgaccgtgctgcaccaggattggctgaacggcaaagagtacaagtgcaaggtgtccaacaaggccctgggagcccccatcgaaaagaccatctccaaggccaagggccagcctcgcgagcctcaggtgtacaccctgccccctagcagagatgagctgaccaagaaccaggtgtccctgacctgtctcgtgaaaggcttctacccctccgatatcgccgtggaatgggagagcaacggccagcccgagaacaactacaagaccaccccccctgtgctggactccgacggctcattcttcctgtactctaagctgacagtggacaagtcccggtggcagcagggcaacgtgttctcctgctccgtgatgcacgaggccctgcacaaccactacacccagaagtccctgtccctgtctcccgggggaggcggaggatctggcggaggcggatccggtggtggcggatctgggggcggtggatctgaggtgcagctgctggaatctgggggaggactggtgcagccaggcggatctctgaggctgtcctgcgctgcttccggctttaccttctccagccacgccatgagttgggtgcgccaggcacccggaaaaggactggaatgggtgtcagccatctgggcctccggcgagcagtactacgccgatagcgtgaagggccggttcaccatctctcgggataacagcaagaatactctgtacctgcagatgaactccctgcgcgctgaagataccgctgtgtattactgcgccaagggctggctgggcaacttcgattactggggccagggaaccctcgtgactgtctcgagcgcttctgtggccgctccctccgtgttcatcttcccaccttccgacgagcagctgaagtccggcactgcctctgtcgtgtgcctgctgaacaacttctaccctcgggaagccaaggtgcagtggaaagtggataacgccctgcagtccggcaactcccaggaatccgtgaccgagcaggactccaaggacagcacctactccctgagcagcaccctgaccctgtccaaggccgactacgagaagcacaaggtgtacgcctgtgaagtgacccaccagggcctgtccagccccgtgaccaagtccttcaaccggggcgagtgc

SEQ ID NO: 227 - protein, 688 aa, Artificial Sequence
  (CLC-564) VHCH1-Heavy chain-(28H1) VHCL
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAFDVGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 228 - DNA, 1350 bp, Artificial Sequence
  DNA (28H1) VHCL-heavy chain hole
gaagtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggacagggcaccctggtcaccgtgtccagcgctagcgtggccgctcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaatccgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 229 - protein, 450 aa, Artificial Sequence
  (28H1) VHCL-heavy chain hole
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 230 - DNA, 1343 bp, Artificial Sequence
  DNA (49B4) VHCH1-heavy chain knob
aggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatactaccgtggtccgtacgactactggggccaagggaccaccgtgaccgtctcctcagctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 231 - protein, 448 aa, Artificial Sequence
  (49B4) VHCH1-heavy chain knob
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYRGPYDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 232 - DNA, 1338 bp, Artificial Sequence
  DNA (1G4) VHCH1-heavy chain knob
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatacggttctatggactactggggccaagggaccaccgtgaccgtctcctcagctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 233 - protein, 446 aa, Artificial Sequence
  (1G4) VHCH1-heavy chain knob
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYGSMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 234 - DNA, 1356 bp, Artificial Sequence
  DNA (20B7) VHCH1-heavy chain knob
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagttaactacccgtactcttactggggtgacttcgactactggggccaagggaccaccgtgaccgtctcctcagctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 235 - protein, 452 aa, Artificial Sequence
  (20B7) VHCH1-heavy chain knob
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARVNYPYSYWGDFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 236 - DNA, 1338 bp, Artificial Sequence
  DNA (CLC-563) VHCH1-heavy chain knob
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgcttgacgttggtgctttcgactactggggccaaggagccctggtcaccgtctcgagtgctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 237 - protein, 446 aa, Artificial Sequence
  (CLC-563) VHCH1-heavy chain knob
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCALDVGAFDYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - DNA, 1338 bp, Artificial Sequence
  DNA (CLC-564) VHCH1-heavy chain knob
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgttcgacgttggtccgttcgactactggggccaaggaaccctggtcaccgtctcgagtgctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 239 - protein, 446 aa, Artificial Sequence
  (CLC-564) VHCH1-heavy chain knob
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAFDVGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - protein, 163 aa, cynomolgus
LQDLCSNCPAGTFCDNNRSQICSPCPPNSFSSAGGQRTCDICRQCKGVFKTRKECSSTSNAECDCISGYHCLGAECSMCEQDCKQGQELTKKGCKDCCFGTFNDQKRGICRPWTNCSLDGKSVLVNGTKERDVVCGPSPADLSPGASSATPPAPAREPGHSPQ

SEQ ID NO: 241 - protein, 164 aa, Mus musculus
VQNSCDNCQPGTFCRKYNPVCKSCPPSTFSSIGGQPNCNICRVCAGYFRFKKFCSSTHNAECECIEGFHCLGPQCTRCEKDCRPGQELTKQGCKTCSLGTFNDQNGTGVCRPWTNCSLDGRSVLKTGTTEKDVVCGPPVVSFSPSTTISVTPEGGPGGHSLQVL

SEQ ID NO: 242 - DNA, 1266 bp, Artificial Sequence
  DNA human 4-1BB antigen Fc knob chain
ctgcaggacccctgcagcaactgccctgccggcaccttctgcgacaacaaccggaaccagatctgcagcccctgcccccccaacagcttcagctctgccggcggacagcggacctgcgacatctgcagacagtgcaagggcgtgttcagaacccggaaagagtgcagcagcaccagcaacgccgagtgcgactgcacccccggcttccattgtctgggagccggctgcagcatgtgcgagcaggactgcaagcagggccaggaactgaccaagaagggctgcaaggactgctgcttcggcaccttcaacgaccagaagcggggcatctgccggccctggaccaactgtagcctggacggcaagagcgtgctggtcaacggcaccaaagaacgggacgtcgtgtgcggccccagccctgctgatctgtctcctggggccagcagcgtgacccctcctgcccctgccagagagcctggccactctcctcaggtcgacgaacagttatattttcagggcggctcacccaaatctgcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcctgaacgacatcttcgaggcccagaagattgaatggcacgag

SEQ ID NO: 243 - DNA, 1266 bp, Artificial Sequence
  DNA cynomolgus 4-1BB antigen Fc knob chain
ttgcaggatctgtgtagtaactgcccagctggtacattctgtgataataacaggagtcagatttgcagtccctgtcctccaaatagtttctccagcgcaggtggacaaaggacctgtgacatatgcaggcagtgtaaaggtgttttcaagaccaggaaggagtgttcctccaccagcaatgcagagtgtgactgcatttcagggtatcactgcctgggggcagagtgcagcatgtgtgaacaggattgtaaacaaggtcaagaattgacaaaaaaaggttgtaaagactgttgctttgggacatttaatgaccagaaacgtggcatctgtcgcccctggacaaactgttctttggatggaaagtctgtgcttgtgaatgggacgaaggagagggacgtggtctgcggaccatctccagccgacctctctccaggagcatcctctgcgaccccgcctgcccctgcgagagagccaggacactctccgcaggtcgacgaacagttatattttcagggcggctcacccaaatctgcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcctgaacgacatcttcgaggcccagaagattgaatggcacgag

SEQ ID NO: 244 - DNA, 1269 bp, Artificial Sequence
  DNA murine 4-1BB antigen Fc knob chain
gtgcagaacagctgcgacaactgccagcccggcaccttctgccggaagtacaaccccgtgtgcaagagctgcccccccagcaccttcagcagcatcggcggccagcccaactgcaacatctgcagagtgtgcgccggctacttccggttcaagaagttctgcagcagcacccacaacgccgagtgcgagtgcatcgagggcttccactgcctgggcccccagtgcaccagatgcgagaaggactgcagacccggccaggaactgaccaagcagggctgtaagacctgcagcctgggcaccttcaacgaccagaacgggaccggcgtgtgccggccttggaccaattgcagcctggacgggagaagcgtgctgaaaaccggcaccaccgagaaggacgtcgtgtgcggccctcccgtggtgtccttcagccctagcaccaccatcagcgtgacccctgaaggcggccctggcggacactctctgcaggtcctggtcgacgaacagttatattttcagggcggctcacccaaatctgcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcctgaacgacatcttcgaggcccagaagattgaatggcacgag

SEQ ID NO: 245 - protein, 422 aa, Artificial Sequence
  human 4-1BB antigen Fc knob chain
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 246 - protein, 422 aa, Artificial Sequence
  cynomolgus 4-1BB antigen Fc knob chain
LQDLCSNCPAGTFCDNNRSQICSPCPPNSFSSAGGQRTCDICRQCKGVFKTRKECSSTSNAECDCISGYHCLGAECSMCEQDCKQGQELTKKGCKDCCFGTFNDQKRGICRPWTNCSLDGKSVLVNGTKERDVVCGPSPADLSPGASSATPPAPAREPGHSPQVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 247 - protein, 423 aa, Artificial Sequence
  murine 4-1BB antigen Fc knob chain
VQNSCDNCQPGTFCRKYNPVCKSCPPSTFSSIGGQPNCNICRVCAGYFRFKKFCSSTHNAECECIEGFHCLGPQCTRCEKDCRPGQELTKQGCKTCSLGTFNDQNGTGVCRPWTNCSLDGRSVLKTGTTEKDVVCGPPVVSFSPSTTISVTPEGGPGGHSLQVLVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 248 - DNA, 28 bp, Artificial Sequence
  Primer MS63
tttcgcacagtaatatacggccgtgtcc

SEQ ID NO: 249 - DNA, 321 bp, Artificial Sequence
  DNA 4-1BB(12B3)  VL
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagtatcattcgtatccgcagacgtttggccagggcaccaaagtcgagatcaag

SEQ ID NO: 250 - DNA, 360 bp, Artificial Sequence
  DNA 4-1BB(12B3)  VH
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctgaattccgtttctacgctgacttcgactactggggccaagggaccaccgtgaccgtctcctca

SEQ ID NO: 251 - DNA, 318 bp, Artificial Sequence
  DNA 4-1BB(25G7)  VL
tcgtctgagctgactcaggaccctgctgtgtctgtggccttgggacagacagtcaggatcacatgccaaggagacagcctcagaagttattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccttgataggcgcggtatgtgggtattcggcggagggaccaagctgaccgtc

SEQ ID NO: 252 - DNA, 354 bp, Artificial Sequence
  DNA 4-1BB(25G7)  VH
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgcgtgacgacccgtggccgccgttcgactactggggccaaggaaccctggtcaccgtctcgagt

SEQ ID NO: 253 - DNA, 321 bp, Artificial Sequence
  DNA 4-1BB(11D5)  VL
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagcttaattcgtatcctcagacgtttggccagggcaccaaagtcgagatcaag

SEQ ID NO: 254 - DNA, 357 bp, Artificial Sequence
  DNA 4-1BB(11D5)  VH
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctactctgatctacggttacttcgactactggggccaagggaccaccgtgaccgtctcctca

SEQ ID NO: 255 - DNA, 321 bp, Artificial Sequence
  DNA 4-1BB(9B11)  VL
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacaggttaattcttatccgcagacgtttggccagggcaccaaagtcgagatcaag

SEQ ID NO: 256 - DNA, 360 bp, Artificial Sequence
  DNA 4-1BB(9B11)  VH
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatcttctggtgcttacccgggttacttcgactactggggccaagggaccaccgtgaccgtctcctca

SEQ ID NO: 257 - DNA, 318 bp, Artificial Sequence
  DNA 4-1BB(20G2)  VL
gacatccagatgacccagtctccatccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagcagcactcgtattatacgtttggccagggcaccaaagtcgagatcaag

SEQ ID NO: 258 - DNA, 360 bp, Artificial Sequence
  DNA 4-1BB(20G2)  VH
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatcttactactgggaatcttacccgttcgactactggggccaagggaccaccgtgaccgtctccagc

SEQ ID NO: 259 - DNA, 642 bp, Artificial Sequence
  DNA 12B3 P329GLALA IgG1 light chain
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagtatcattcgtatccgcagacgtttggccagggcaccaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 260 - DNA, 1350 bp, Artificial Sequence
  DNA 12B3 P329GLALA IgG1 heavy chain
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctgaattccgtttctacgctgacttcgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 261 - protein, 214 aa, Artificial Sequence
  12B3 P329GLALA IgG1 light chain
DIQMTQSPSTLSASVGDRVTITCRASQSISSWLAWYQQKPGKAPKLLIYDASSLESGVPSRFSGSGSGTEFTLTISSLQPDDFATYYCQQYHSYPQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 262 - protein, 450 aa, Artificial Sequence
  12B3 P329GLALA IgG1 heavy chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSEFRFYADFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 263 - DNA, 639 bp, Artificial Sequence
  DNA 25G7 P329GLALA IgG1 light chain
tcgtctgagctgactcaggaccctgctgtgtctgtggccttgggacagacagtcaggatcacatgccaaggagacagcctcagaagttattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccttgataggcgcggtatgtgggtattcggcggagggaccaagctgaccgtcctaggtcaacccaaggctgcccccagcgtgaccctgttcccccccagcagcgaggaactgcaggccaacaaggccaccctggtctgcctgatcagcgacttctacccaggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaggtcctacagctgccaggtgacccacgagggcagcaccgtggagaaaaccgtggcccccaccgagtgcagc

SEQ ID NO: 264 - DNA, 1344 bp, Artificial Sequence
  DNA 25G7 P329GLALA IgG1 heavy chain
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgcgtgacgacccgtggccgccgttcgactactggggccaaggaaccctggtcaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 265 - protein, 213 aa, Artificial Sequence
  25G7 P329GLALA IgG1 light chain
SSELTQDPAVSVALGQTVRITCQGDSLRSYYASWYQQKPGQAPVLVIYGKNNRPSGIPDRFSGSSSGNTASLTITGAQAEDEADYYCNSLDRRGMWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 266 - protein, 448 aa, Artificial Sequence
  25G7 P329GLALA IgG1 heavy chain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDDPWPPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 267 - DNA, 642 bp, Artificial Sequence
  DNA 11D5 P329GLALA IgG1 light chain
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagcttaattcgtatcctcagacgtttggccagggcaccaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 268 - DNA, 1347 bp, Artificial Sequence
  DNA 11D5 P329GLALA IgG1 heavy chain
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctactctgatctacggttacttcgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 269 - protein, 214 aa, Artificial Sequence
  11D5 P329GLALA IgG1 light chain
DIQMTQSPSTLSASVGDRVTITCRASQSISSWLAWYQQKPGKAPKLLIYDASSLESGVPSRFSGSGSGTEFTLTISSLQPDDFATYYCQQLNSYPQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 270 - protein, 449 aa, Artificial Sequence
  11D5 P329GLALA IgG1 heavy chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSTLIYGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 271 - DNA, 642 bp, Artificial Sequence
  DNA 9B11 P329GLALA IgG1 light chain
gacatccagatgacccagtctccttccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacaggttaattcttatccgcagacgtttggccagggcaccaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 272 - DNA, 1350 bp, Artificial Sequence
  DNA 9B11 P329GLALA IgG1 heavy chain
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatcttctggtgcttacccgggttacttcgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 273 - protein, 214 aa, Artificial Sequence
  9B11 P329GLALA IgG1 light chain
DIQMTQSPSTLSASVGDRVTITCRASQSISSWLAWYQQKPGKAPKLLIYDASSLESGVPSRFSGSGSGTEFTLTISSLQPDDFATYYCQQVNSYPQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 274 - protein, 450 aa, Artificial Sequence
  9B11 P329GLALA IgG1 heavy chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSSGAYPGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 275 - DNA, 639 bp, Artificial Sequence
  DNA 20G2 P329GLALA IgG1 light chain
gacatccagatgacccagtctccatccaccctgtctgcatctgtaggagaccgtgtcaccatcacttgccgtgccagtcagagtattagtagctggttggcctggtatcagcagaaaccagggaaagcccctaagctcctgatctatgatgcctccagtttggaaagtggggtcccatcacgtttcagcggcagtggatccgggacagaattcactctcaccatcagcagcttgcagcctgatgattttgcaacttattactgccaacagcagcactcgtattatacgtttggccagggcaccaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 276 - DNA, 1350 bp, Artificial Sequence
  DNA 20G2 P329GLALA IgG1 heavy chain
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatcttactactgggaatcttacccgttcgactactggggccaagggaccaccgtgaccgtctccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 277 - protein, 213 aa, Artificial Sequence
  20G2 P329GLALA IgG1 light chain
DIQMTQSPSTLSASVGDRVTITCRASQSISSWLAWYQQKPGKAPKLLIYDASSLESGVPSRFSGSGSGTEFTLTISSLQPDDFATYYCQQQHSYYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 278 - protein, 450 aa, Artificial Sequence
  20G2 P329GLALA IgG1 heavy chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSYYWESYPFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 279 - protein, 421 aa, Artificial Sequence
  mu4-1BB D1 / hu4-1BB D2 Fc knob
VQNSCDNCQPGTFCRKYNPVCKSCPPSTFSSIGGQPNCNICRVCAGYFRFKKFCSSTHNAECECIEGFHCLGPQCTRCEKDCRPGQELTKQGCKDCCFGTFNDQKRGICRPWTNCSLDGKSVLVNGTKERDVVCGPSPADLSPGASSVTPPAPAREPGHSPQVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 280 - protein, 424 aa, Artificial Sequence
  hu4-1BB D1 / mu4-1BB D2 Fc knob
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKTCSLGTFNDQNGTGVCRPWTNCSLDGRSVLKTGTTEKDVVCGPPVVSFSPSTTISVTPEGGPGGHSLQVLVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 281 - protein, 354 aa, Artificial Sequence
  hu 4-1BB D1 Fc knob
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCKVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 282 - protein, 94 aa, Artificial Sequence
  Murine 4-1BB domain D1 (N-terminus)
VQNSCDNCQPGTFCRKYNPVCKSCPPSTFSSIGGQPNCNICRVCAGYFRFKKFCSSTHNAECECIEGFHCLGPQCTRCEKDCRPGQELTKQGCK

SEQ ID NO: 283 - protein, 68 aa, Artificial Sequence
  Human 4-1BB domain D2 (C-terminus)
DCCFGTFNDQKRGICRPWTNCSLDGKSVLVNGTKERDVVCGPSPADLSPGASSVTPPAPAREPGHSPQ

SEQ ID NO: 284 - protein, 95 aa, Artificial Sequence
  Human 4-1BB domain D1 (N-terminus)
LQDPCSNCPAGTFCDNNRNQICSPCPPNSFSSAGGQRTCDICRQCKGVFRTRKECSSTSNAECDCTPGFHCLGAGCSMCEQDCKQGQELTKKGCK

SEQ ID NO: 285 - protein, 70 aa, Artificial Sequence
  Murine 4-1BB domain D2 (C-terminus)
TCSLGTFNDQNGTGVCRPWTNCSLDGRSVLKTGTTEKDVVCGPPVVSFSPSTTISVTPEGGPGGHSLQVL

SEQ ID NO: 286 - DNA, 2076 bp, Artificial Sequence
  DNA (12B3) VHCH1-Heavy chain-(28H1) VHCL
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctgaattccgtttctacgctgacttcgactactggggccaagggaccaccgtgaccgtctcctcagctagcaccaagggcccatccgtgttccctctggccccttccagcaagtctacctctggcggcacagccgctctgggctgcctcgtgaaggactacttccccgagcctgtgacagtgtcctggaactctggcgccctgacatccggcgtgcacacctttccagctgtgctgcagtcctccggcctgtactccctgtcctccgtcgtgacagtgccctccagctctctgggcacccagacctacatctgcaacgtgaaccacaagccctccaacaccaaggtggacaagaaggtggaacccaagtcctgcgacaagacccacacctgtcccccttgtcctgcccctgaagctgctggcggccctagcgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaatgccaagaccaagcctagagaggaacagtacaactccacctaccgggtggtgtccgtgctgaccgtgctgcaccaggattggctgaacggcaaagagtacaagtgcaaggtgtccaacaaggccctgggagcccccatcgaaaagaccatctccaaggccaagggccagcctcgcgagcctcaggtgtacaccctgccccctagcagagatgagctgaccaagaaccaggtgtccctgacctgtctcgtgaaaggcttctacccctccgatatcgccgtggaatgggagagcaacggccagcccgagaacaactacaagaccaccccccctgtgctggactccgacggctcattcttcctgtactctaagctgacagtggacaagtcccggtggcagcagggcaacgtgttctcctgctccgtgatgcacgaggccctgcacaaccactacacccagaagtccctgtccctgtctcccgggggaggcggaggatctggcggaggcggatccggtggtggcggatctgggggcggtggatctgaggtgcagctgctggaatctgggggaggactggtgcagccaggcggatctctgaggctgtcctgcgctgcttccggctttaccttctccagccacgccatgagttgggtgcgccaggcacccggaaaaggactggaatgggtgtcagccatctgggcctccggcgagcagtactacgccgatagcgtgaagggccggttcaccatctctcgggataacagcaagaatactctgtacctgcagatgaactccctgcgcgctgaagataccgctgtgtattactgcgccaagggctggctgggcaacttcgattactggggccagggaaccctcgtgactgtctcgagcgcttctgtggccgctccctccgtgttcatcttcccaccttccgacgagcagctgaagtccggcactgcctctgtcgtgtgcctgctgaacaacttctaccctcgggaagccaaggtgcagtggaaagtggataacgccctgcagtccggcaactcccaggaatccgtgaccgagcaggactccaaggacagcacctactccctgagcagcaccctgaccctgtccaaggccgactacgagaagcacaaggtgtacgcctgtgaagtgacccaccagggcctgtccagccccgtgaccaagtccttcaaccggggcgagtgc

SEQ ID NO: 287 - protein, 692 aa, Artificial Sequence
  (12B3) VHCH1-Heavy chain-(28H1) VHCL
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSEFRFYADFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 288 - DNA, 2070 bp, Artificial Sequence
  DNA (25G7) VHCH1-Heavy chain-(28H1) VHCL
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgcgtgacgacccgtggccgccgttcgactactggggccaaggaaccctggtcaccgtctcgagtgctagcaccaagggcccatccgtgttccctctggccccttccagcaagtctacctctggcggcacagccgctctgggctgcctcgtgaaggactacttccccgagcctgtgacagtgtcctggaactctggcgccctgacatccggcgtgcacacctttccagctgtgctgcagtcctccggcctgtactccctgtcctccgtcgtgacagtgccctccagctctctgggcacccagacctacatctgcaacgtgaaccacaagccctccaacaccaaggtggacaagaaggtggaacccaagtcctgcgacaagacccacacctgtcccccttgtcctgcccctgaagctgctggcggccctagcgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaatgccaagaccaagcctagagaggaacagtacaactccacctaccgggtggtgtccgtgctgaccgtgctgcaccaggattggctgaacggcaaagagtacaagtgcaaggtgtccaacaaggccctgggagcccccatcgaaaagaccatctccaaggccaagggccagcctcgcgagcctcaggtgtacaccctgccccctagcagagatgagctgaccaagaaccaggtgtccctgacctgtctcgtgaaaggcttctacccctccgatatcgccgtggaatgggagagcaacggccagcccgagaacaactacaagaccaccccccctgtgctggactccgacggctcattcttcctgtactctaagctgacagtggacaagtcccggtggcagcagggcaacgtgttctcctgctccgtgatgcacgaggccctgcacaaccactacacccagaagtccctgtccctgtctcccgggggaggcggaggatctggcggaggcggatccggtggtggcggatctgggggcggtggatctgaggtgcagctgctggaatctgggggaggactggtgcagccaggcggatctctgaggctgtcctgcgctgcttccggctttaccttctccagccacgccatgagttgggtgcgccaggcacccggaaaaggactggaatgggtgtcagccatctgggcctccggcgagcagtactacgccgatagcgtgaagggccggttcaccatctctcgggataacagcaagaatactctgtacctgcagatgaactccctgcgcgctgaagataccgctgtgtattactgcgccaagggctggctgggcaacttcgattactggggccagggaaccctcgtgactgtctcgagcgcttctgtggccgctccctccgtgttcatcttcccaccttccgacgagcagctgaagtccggcactgcctctgtcgtgtgcctgctgaacaacttctaccctcgggaagccaaggtgcagtggaaagtggataacgccctgcagtccggcaactcccaggaatccgtgaccgagcaggactccaaggacagcacctactccctgagcagcaccctgaccctgtccaaggccgactacgagaagcacaaggtgtacgcctgtgaagtgacccaccagggcctgtccagccccgtgaccaagtccttcaaccggggcgagtgc

SEQ ID NO: 289 - protein, 690 aa, Artificial Sequence
  (25G7) VHCH1-Heavy chain-(28H1) VHCL
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDDPWPPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 290 - DNA, 2073 bp, Artificial Sequence
  DNA (11D5) VHCH1-Heavy chain-(28H1) VHCL
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctactctgatctacggttacttcgactactggggccaagggaccaccgtgaccgtctcctcagctagcaccaagggcccatccgtgttccctctggccccttccagcaagtctacctctggcggcacagccgctctgggctgcctcgtgaaggactacttccccgagcctgtgacagtgtcctggaactctggcgccctgacatccggcgtgcacacctttccagctgtgctgcagtcctccggcctgtactccctgtcctccgtcgtgacagtgccctccagctctctgggcacccagacctacatctgcaacgtgaaccacaagccctccaacaccaaggtggacaagaaggtggaacccaagtcctgcgacaagacccacacctgtcccccttgtcctgcccctgaagctgctggcggccctagcgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaatgccaagaccaagcctagagaggaacagtacaactccacctaccgggtggtgtccgtgctgaccgtgctgcaccaggattggctgaacggcaaagagtacaagtgcaaggtgtccaacaaggccctgggagcccccatcgaaaagaccatctccaaggccaagggccagcctcgcgagcctcaggtgtacaccctgccccctagcagagatgagctgaccaagaaccaggtgtccctgacctgtctcgtgaaaggcttctacccctccgatatcgccgtggaatgggagagcaacggccagcccgagaacaactacaagaccaccccccctgtgctggactccgacggctcattcttcctgtactctaagctgacagtggacaagtcccggtggcagcagggcaacgtgttctcctgctccgtgatgcacgaggccctgcacaaccactacacccagaagtccctgtccctgtctcccgggggaggcggaggatctggcggaggcggatccggtggtggcggatctgggggcggtggatctgaggtgcagctgctggaatctgggggaggactggtgcagccaggcggatctctgaggctgtcctgcgctgcttccggctttaccttctccagccacgccatgagttgggtgcgccaggcacccggaaaaggactggaatgggtgtcagccatctgggcctccggcgagcagtactacgccgatagcgtgaagggccggttcaccatctctcgggataacagcaagaatactctgtacctgcagatgaactccctgcgcgctgaagataccgctgtgtattactgcgccaagggctggctgggcaacttcgattactggggccagggaaccctcgtgactgtctcgagcgcttctgtggccgctccctccgtgttcatcttcccaccttccgacgagcagctgaagtccggcactgcctctgtcgtgtgcctgctgaacaacttctaccctcgggaagccaaggtgcagtggaaagtggataacgccctgcagtccggcaactcccaggaatccgtgaccgagcaggactccaaggacagcacctactccctgagcagcaccctgaccctgtccaaggccgactacgagaagcacaaggtgtacgcctgtgaagtgacccaccagggcctgtccagccccgtgaccaagtccttcaaccggggcgagtgc

SEQ ID NO: 291 - protein, 691 aa, Artificial Sequence
  (11D5) VHCH1-Heavy chain-(28H1) VHCL
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSTLIYGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 292 - DNA, 2076 bp, Artificial Sequence
  DNA (9B11) VHCH1-Heavy chain-(28H1) VHCL
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatcttctggtgcttacccgggttacttcgactactggggccaagggaccaccgtgaccgtctcctcagctagcaccaagggcccatccgtgttccctctggccccttccagcaagtctacctctggcggcacagccgctctgggctgcctcgtgaaggactacttccccgagcctgtgacagtgtcctggaactctggcgccctgacatccggcgtgcacacctttccagctgtgctgcagtcctccggcctgtactccctgtcctccgtcgtgacagtgccctccagctctctgggcacccagacctacatctgcaacgtgaaccacaagccctccaacaccaaggtggacaagaaggtggaacccaagtcctgcgacaagacccacacctgtcccccttgtcctgcccctgaagctgctggcggccctagcgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaatgccaagaccaagcctagagaggaacagtacaactccacctaccgggtggtgtccgtgctgaccgtgctgcaccaggattggctgaacggcaaagagtacaagtgcaaggtgtccaacaaggccctgggagcccccatcgaaaagaccatctccaaggccaagggccagcctcgcgagcctcaggtgtacaccctgccccctagcagagatgagctgaccaagaaccaggtgtccctgacctgtctcgtgaaaggcttctacccctccgatatcgccgtggaatgggagagcaacggccagcccgagaacaactacaagaccaccccccctgtgctggactccgacggctcattcttcctgtactctaagctgacagtggacaagtcccggtggcagcagggcaacgtgttctcctgctccgtgatgcacgaggccctgcacaaccactacacccagaagtccctgtccctgtctcccgggggaggcggaggatctggcggaggcggatccggtggtggcggatctgggggcggtggatctgaggtgcagctgctggaatctgggggaggactggtgcagccaggcggatctctgaggctgtcctgcgctgcttccggctttaccttctccagccacgccatgagttgggtgcgccaggcacccggaaaaggactggaatgggtgtcagccatctgggcctccggcgagcagtactacgccgatagcgtgaagggccggttcaccatctctcgggataacagcaagaatactctgtacctgcagatgaactccctgcgcgctgaagataccgctgtgtattactgcgccaagggctggctgggcaacttcgattactggggccagggaaccctcgtgactgtctcgagcgcttctgtggccgctccctccgtgttcatcttcccaccttccgacgagcagctgaagtccggcactgcctctgtcgtgtgcctgctgaacaacttctaccctcgggaagccaaggtgcagtggaaagtggataacgccctgcagtccggcaactcccaggaatccgtgaccgagcaggactccaaggacagcacctactccctgagcagcaccctgaccctgtccaaggccgactacgagaagcacaaggtgtacgcctgtgaagtgacccaccagggcctgtccagccccgtgaccaagtccttcaaccggggcgagtgc

SEQ ID NO: 293 - protein, 692 aa, Artificial Sequence
  (9B11) VHCH1-Heavy chain-(28H1) VHCL
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSSGAYPGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 294 - DNA, 1350 bp, Artificial Sequence
  DNA (12B3) VHCH1-heavy chain knob
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctgaattccgtttctacgctgacttcgactactggggccaagggaccaccgtgaccgtctcctcagctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 295 - protein, 450 aa, Artificial Sequence
  (12B3) VHCH1-heavy chain knob
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSEFRFYADFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 296 - DNA, 1344 bp, Artificial Sequence
  DNA (25G7) VHCH1-heavy chain knob
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgcgtgacgacccgtggccgccgttcgactactggggccaaggaaccctggtcaccgtctcgagtgctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 297 - protein, 448 aa, Artificial Sequence
  (25G7) VHCH1-heavy chain knob
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDDPWPPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 298 - DNA, 1347 bp, Artificial Sequence
  DNA (11D5) VHCH1-heavy chain knob
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctactctgatctacggttacttcgactactggggccaagggaccaccgtgaccgtctcctcagctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 299 - protein, 449 aa, Artificial Sequence
  (11D5) VHCH1-heavy chain knob
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSTLIYGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - DNA, 1350 bp, Artificial Sequence
  DNA (9B11) VHCH1-heavy chain knob
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatcttctggtgcttacccgggttacttcgactactggggccaagggaccaccgtgaccgtctcctcagctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 301 - protein, 450 aa, Artificial Sequence
  (9B11) VHCH1-heavy chain knob
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSSGAYPGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 302 - DNA, 1338 bp, Artificial Sequence
  DNA (8H9) VHCH1-heavy chain knob
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatacggttggatggactactggggccaagggaccaccgtgaccgtctcctcagctagcaccaagggccctagcgtgttccctctggcccctagcagcaagagcacaagtggaggaacagccgccctgggctgcctggtcaaggactacttccccgagcccgtgaccgtgtcctggaattctggcgccctgacaagcggcgtgcacacatttccagccgtgctgcagagcagcggcctgtactctctgagcagcgtcgtgaccgtgccctctagctctctgggcacccagacctacatctgcaacgtgaaccacaagcccagcaacaccaaagtggacaagaaggtggaacccaagagctgcgacaagacccacacctgtcccccttgccctgcccctgaagctgctggtggcccttccgtgttcctgttccccccaaagcccaaggacaccctgatgatcagccggacccccgaagtgacctgcgtggtggtcgatgtgtcccacgaggaccctgaagtgaagttcaattggtacgtggacggcgtggaagtgcacaatgccaagaccaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 303 - protein, 446 aa, Artificial Sequence
  (8H9) VHCH1-heavy chain knob
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYGWMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 304 - DNA, 1752 bp, Artificial Sequence
  nucleotide sequence of (49B4) VHCH1 Fc knob VH (4B9)
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatactaccgtggtccgtacgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggaggatccgaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcaccgtgtccagc

SEQ ID NO: 305 - DNA, 1725 bp, Artificial Sequence
  nucleotide sequence of (49B4) VHCH1 Fc hole VL (4B9)
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatactaccgtggtccgtacgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggtggatctgagatcgtgctgacccagtctcccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaag

SEQ ID NO: 306 - protein, 584 aa, Artificial Sequence
  (49B4) VHCH1 Fc knob VH (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYRGPYDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 307 - protein, 575 aa, Artificial Sequence
  (49B4) VHCH1 Fc hole VL (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYRGPYDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 308 - DNA, 1749 bp, Artificial Sequence
  nucleotide sequence of (49B4) VHCH1 Fc knob VH (28H1)
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatactaccgtggtccgtacgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccggaggagggggaagtggcggcggaggatctgaggtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggccagggcaccctggtcaccgtgtccagc

SEQ ID NO: 309 - DNA, 1725 bp, Artificial Sequence
  nuclelotide sequence of (49B4) VHCH1 Fc hole VL (28H1)
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatactaccgtggtccgtacgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggtggtggcggatctgggggcggtggatctgagatcgtgctgacccagtctcccggcaccctgagcctgagccctggcgagagagccaccctgagctgcagagccagccagagcgtgagccggagctacctggcctggtatcagcagaagcccggccaggcccccagactgctgatcatcggcgccagcacccgggccaccggcatccccgatagattcagcggcagcggctccggcaccgacttcaccctgaccatcagccggctggaacccgaggacttcgccgtgtactactgccagcagggccaggtgatcccccccaccttcggccagggcaccaaggtggaaatcaag

SEQ ID NO: 310 - protein, 583 aa, Artificial Sequence
  (49B4) VHCH1 Fc knob VH (28H1)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYRGPYDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 311 - protein, 575 aa, Artificial Sequence
  (49B4) VHCH1 Fc hole VL (28H1)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYRGPYDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIK

SEQ ID NO: 312 - DNA, 1746 bp, Artificial Sequence
  nucleotide sequence of (49B4) VHCH1 Fc knob VH (DP47)
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatactaccgtggtccgtacgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccggaggagggggaagtggcggcggaggatctgaggtgcaattgttggagtctgggggaggcttggtacagcctggggggtccctgagactctcctgtgcagccagcggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaggcagcggatttgactactggggccaaggaaccctggtcaccgtctcgagc

SEQ ID NO: 313 - DNA, 1725 bp, Artificial Sequence
  nucelotide sequence of (49B4) VHCH1 Fc hole VL (DP47)
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagagaatactaccgtggtccgtacgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggaggcggcggaagcggagggggaggctctgaaattgtgctgacccagagccccggcaccctgtcactgtctccaggcgaaagagccaccctgagctgcagagccagccagagcgtgtccagctcttacctggcctggtatcagcagaagcccggacaggcccccagactgctgatctacggcgcctcttctagagccaccggcatccccgatagattcagcggcagcggctccggcaccgacttcaccctgacaatcagcagactggaacccgaggactttgccgtgtattactgccagcagtacggcagcagccccctgacctttggccagggcaccaaggtggaaatcaaa

SEQ ID NO: 314 - protein, 582 aa, Artificial Sequence
  (49B4) VHCH1 Fc knob VH (DP47)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYRGPYDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSS

SEQ ID NO: 315 - protein, 575 aa, Artificial Sequence
  (49B4) VHCH1 Fc hole VL (DP47)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYRGPYDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIK

SEQ ID NO: 316 - DNA, 1758 bp, Artificial Sequence
  DNA (12B3) VHCH1 Fc knob VH (4B9) (HC1)
caggtgcaattggtgcagtctggggctgaggtgaagaagcctgggtcctcggtgaaggtctcctgcaaggcctccggaggcacattcagcagctacgctataagctgggtgcgacaggcccctggacaagggctggagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctgaattccgtttctacgctgacttcgactactggggccaagggaccaccgtgaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcaccgtgtccagc

SEQ ID NO: 317 - DNA, 1731 bp, Artificial Sequence
  DNA (12B3) VHCH1 Fc hole VL (4B9)
caggtgcaattggtgcagtctggggctgaggtgaagaagcctgggtcctcggtgaaggtctcctgcaaggcctccggaggcacattcagcagctacgctataagctgggtgcgacaggcccctggacaagggctggagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctgaattccgtttctacgctgacttcgactactggggccaagggaccaccgtgaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgagatcgtgctgacccagtctcccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaag

SEQ ID NO: 318 - protein, 586 aa, Artificial Sequence
  (12B3) VHCH1 Fc knob VH (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSEFRFYADFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 319 - protein, 577 aa, Artificial Sequence
  (12B3) VHCH1 Fc hole VL (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSEFRFYADFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 320 - DNA, 1752 bp, Artificial Sequence
  DNA (25G7) VHCH1 Fc knob VH (4B9)
gaggtgcagctgctggaatctggcggcggactggtgcagcctggcggatctctgagactgagctgtgccgccagcggcttcaccttcagcagctacgccatgagctgggtgcgccaggcccctggaaaaggcctggaatgggtgtccgccatctctggcagcggcggcagcacctactacgccgattctgtgaagggccggttcaccatcagccgggacaacagcaagaacaccctgtacctgcagatgaacagcctgcgggccgaggacaccgccgtgtactattgcgccagggacgacccctggcccccctttgattattggggacagggcaccctcgtgaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcaccgtgtccagc

SEQ ID NO: 321 - DNA, 1725 bp, Artificial Sequence
  DNA (25G7) VHCH1 Fc hole VL (4B9)
gaggtgcagctgctggaatctggcggcggactggtgcagcctggcggatctctgagactgagctgtgccgccagcggcttcaccttcagcagctacgccatgagctgggtgcgccaggcccctggaaaaggcctggaatgggtgtccgccatctctggcagcggcggcagcacctactacgccgattctgtgaagggccggttcaccatcagccgggacaacagcaagaacaccctgtacctgcagatgaacagcctgcgggccgaggacaccgccgtgtactattgcgccagggacgacccctggcccccctttgattattggggacagggcaccctcgtgaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgagatcgtgctgacccagtctcccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaag

SEQ ID NO: 322 - protein, 584 aa, Artificial Sequence
  (25G7) VHCH1 Fc knob VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDDPWPPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 323 - protein, 575 aa, Artificial Sequence
  (25G7) VHCH1 Fc hole VL (4B9)
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDDPWPPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 324 - DNA, 1755 bp, Artificial Sequence
  DNA (11D5) VHCH1 Fc knob VH (4B9)
caggtgcagctggtgcagtctggcgccgaagtgaagaaacccggcagcagcgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacaccgccgtgtactactgtgccagaagcaccctgatctacggctacttcgactactggggccagggcaccaccgtgaccgtgtctagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcaccgtgtccagc

SEQ ID NO: 325 - DNA, 1728 bp, Artificial Sequence
  DNA (11D5) VHCH1 Fc hole VL (4B9)
caggtgcagctggtgcagtctggcgccgaagtgaagaaacccggcagcagcgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacaccgccgtgtactactgtgccagaagcaccctgatctacggctacttcgactactggggccagggcaccaccgtgaccgtgtctagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgagatcgtgctgacccagtctcccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaag

SEQ ID NO: 326 - protein, 585 aa, Artificial Sequence
  (11D5) VHCH1 Fc knob VH (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSTLIYGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 327 - protein, 576 aa, Artificial Sequence
  (11D5) VHCH1 Fc hole VL (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSTLIYGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 328 - DNA, 1758 bp, Artificial Sequence
  DNA (9B11) VHCH1 Fc knob VH (4B9)
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatcttctggtgcttacccgggttacttcgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcaccgtgtccagc

SEQ ID NO: 329 - DNA, 1731 bp, Artificial Sequence
  DNA (9B11) VHCH1 Fc hole VL (4B9)
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatcttctggtgcttacccgggttacttcgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgagatcgtgctgacccagtctcccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaag

SEQ ID NO: 330 - protein, 586 aa, Artificial Sequence
  (9B11) VHCH1 Fc knob VH (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSSGAYPGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 331 - protein, 577 aa, Artificial Sequence
  (9B11) VHCH1 Fc hole VL (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSSGAYPGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 332 - DNA, 1731 bp, Artificial Sequence
  DNA (12B3) VHCH1 Fc knob VL (4B9)
caggtgcaattggtgcagtctggggctgaggtgaagaagcctgggtcctcggtgaaggtctcctgcaaggcctccggaggcacattcagcagctacgctataagctgggtgcgacaggcccctggacaagggctggagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctgaattccgtttctacgctgacttcgactactggggccaagggaccaccgtgaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgagatcgtgctgacccagtctcccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaag

SEQ ID NO: 333 - DNA, 1758 bp, Artificial Sequence
  DNA (12B3) VHCH1 Fc hole VH (4B9)
caggtgcaattggtgcagtctggggctgaggtgaagaagcctgggtcctcggtgaaggtctcctgcaaggcctccggaggcacattcagcagctacgctataagctgggtgcgacaggcccctggacaagggctggagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctgaattccgtttctacgctgacttcgactactggggccaagggaccaccgtgaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcaccgtgtccagc

SEQ ID NO: 334 - protein, 577 aa, Artificial Sequence
  (12B3) VHCH1 Fc knob VL (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSEFRFYADFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 335 - protein, 586 aa, Artificial Sequence
  (12B3) VHCH1 Fc hole VH (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSEFRFYADFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 336 - DNA, 1725 bp, Artificial Sequence
  DNA (25G7) VHCH1 Fc knob VL (4B9)
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgcgtgacgacccgtggccgccgttcgactactggggccaaggaaccctggtcaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgagatcgtgctgacccagtctcccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaag

SEQ ID NO: 337 - DNA, 1752 bp, Artificial Sequence
  DNA (25G7) VHCH1 Fc hole VH (4B9)
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgcgtgacgacccgtggccgccgttcgactactggggccaaggaaccctggtcaccgtctcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcaccgtgtccagc

SEQ ID NO: 338 - protein, 575 aa, Artificial Sequence
  (25G7) VHCH1 Fc knob VL (4B9)
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDDPWPPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 339 - protein, 584 aa, Artificial Sequence
  (25G7) VHCH1 Fc hole VH (4B9)
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDDPWPPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 340 - DNA, 1728 bp, Artificial Sequence
  DNA (11D5) VHCH1 Fc knob VL (4B9)
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctactctgatctacggttacttcgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgagatcgtgctgacccagtctcccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaag

SEQ ID NO: 341 - DNA, 1755 bp, Artificial Sequence
  DNA (11D5) VHCH1 Fc hole VH (4B9)
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatctactctgatctacggttacttcgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcaccgtgtccagc

SEQ ID NO: 342 - protein, 576 aa, Artificial Sequence
  (11D5) VHCH1 Fc knob VL (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSTLIYGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 343 - protein, 585 aa, Artificial Sequence
  (11D5) VHCH1 Fc hole VH (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSTLIYGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 344 - DNA, 1731 bp, Artificial Sequence
  DNA (9B11) VHCH1 Fc knob VL (4B9)
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatcttctggtgcttacccgggttacttcgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatctgggggcggaggttccggaggcggtggatctgagatcgtgctgacccagtctcccggcaccctgtctctgagccctggcgagagagccaccctgtcctgcagagcctcccagtccgtgacctcctcctacctcgcctggtatcagcagaagcccggccaggcccctcggctgctgatcaacgtgggcagtcggagagccaccggcatccctgaccggttctccggctctggctccggcaccgacttcaccctgaccatctcccggctggaacccgaggacttcgccgtgtactactgccagcagggcatcatgctgccccccacctttggccagggcaccaaggtggaaatcaag

SEQ ID NO: 345 - DNA, 1758 bp, Artificial Sequence
  DNA (9B11) VHCH1 Fc hole VH (4B9)
caggtgcaattggtgcagtctggggctgaggtgaagaagcctgggtcctcggtgaaggtctcctgcaaggcctccggaggcacattcagcagctacgctataagctgggtgcgacaggcccctggacaagggctcgagtggatgggagggatcatccctatctttggtacagcaaactacgcacagaagttccagggcagggtcaccattactgcagacaaatccacgagcacagcctacatggagctgagcagcctgagatctgaggacaccgccgtgtattactgtgcgagatcttctggtgcttacccgggttacttcgactactggggccaagggaccaccgtgaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggcggcggaggttccggaggcggaggatccgaggtgcagctgctcgaaagcggcggaggactggtgcagcctggcggcagcctgagactgtcttgcgccgccagcggcttcaccttcagcagctacgccatgagctgggtccgccaggcccctggcaagggactggaatgggtgtccgccatcatcggctctggcgccagcacctactacgccgacagcgtgaagggccggttcaccatcagccgggacaacagcaagaacaccctgtacctgcagatgaacagcctgcgggccgaggacaccgccgtgtactactgcgccaagggatggttcggcggcttcaactactggggacagggcaccctggtcaccgtgtccagc

SEQ ID NO: 346 - protein, 577 aa, Artificial Sequence
  (9B11) VHCH1 Fc knob VL (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSSGAYPGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 347 - protein, 586 aa, Artificial Sequence
  (9B11) VHCH1 Fc hole VH (4B9)
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSSGAYPGYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

What is claimed is:

1. An antibody or antibody fragment thereof that specifically binds to OX40, wherein said antibody or fragment thereof comprises:
   (a) a heavy chain variable domain (VH) comprising
      (i) an CDR-H1 comprising the amino acid sequence of SEQ ID NO:2;
      (ii) an CDR-H2 comprising the amino acid sequence of SEQ ID NO:4;
      (iii) an CDR-H3 comprising the amino acid sequence of SEQ ID NO:7; and
   (b) a light chain variable domain (VL) comprising
      (i) an CDR-L1 comprising the amino acid sequence of SEQ ID NO:13;
      (ii) an CDR-L2 comprising the amino acid sequence of SEQ ID NO:16; and
      (iii) an CDR-L3 comprising the amino acid sequence of SEQ ID NO:20.

2. The antibody or fragment thereof of claim 1, wherein the VH has at least 95% amino acid sequence identity to SEQ ID NO:27, and the VL has at least 95% amino acid sequence identity to SEQ ID NO:28.

3. The antibody or fragment thereof of claim 1, wherein the VH has at least 97% amino acid sequence identity to SEQ ID NO:27, and the VL has at least 97% amino acid sequence identity to SEQ ID NO:28.

4. The antibody or fragment thereof of claim 1, wherein the VH has at least 99% amino acid sequence identity to SEQ ID NO:27, and the VL has at least 99% amino acid sequence identity to SEQ ID NO:28.

5. The antibody or fragment thereof of claim 1, wherein the VH comprises the amino acid sequence of SEQ ID NO:27, and the VL comprises the amino acid sequence of SEQ ID NO:28.

6. The antibody or fragment thereof of claim 1 that is a monoclonal antibody.

7. The antibody or fragment thereof of claim 5 that is a monoclonal antibody.

8. The antibody or fragment thereof of claim 6 that is a humanized or human antibody.

9. The antibody or fragment thereof of claim 7 that is a humanized or human antibody.

10. The antibody or fragment thereof of claim 1 that is a scFv, a Fab, or a Fab' fragment.

11. The antibody or fragment thereof of claim 5 that is a scFv, a Fab, or a Fab' fragment.

12. The antibody or fragment thereof of claim 1 that is an antibody comprising an Fc domain of the human IgG1 subclass.

13. The antibody of claim 12 that comprises the amino acid mutations L234A, L235A and P329G (numbering according to Kabat EU index).

14. The antibody or fragment thereof of claim 5 that is an antibody comprising an Fc domain of the human IgG1 subclass.

15. The antibody of claim 14 that comprises the amino acid mutations L234A, L235A and P329G (numbering according to Kabat EU index).

16. An antibody that specifically binds to OX40, comprising:
   (a) a light chain comprising the amino acid sequence of SEQ ID NO:186; and
   (b) a heavy chain comprising the amino acid sequence of SEQ ID NO:187.

17. The antibody of claim 16 that is a monoclonal antibody.

18. A composition comprising the antibody or fragment of claim 1 and a pharmaceutically acceptable excipient.

19. A composition comprising the antibody or fragment of claim 5 and a pharmaceutically acceptable excipient.

20. A composition comprising the antibody or fragment of claim 16 and a pharmaceutically acceptable excipient.

* * * * *